United States Patent 12,642,819 (COMPOSITIONS AND METHODS FOR TREATING INFLAMMATORY BOWEL DISEASE) - sequence listing, part 81

SEQ ID NO: 41 - DNA, 2649499 bp, Enterococcus faecium (residues 1,324,751-2,649,499 of 2,649,499)
  modified_base (92058)..(92155): a, c, t, g, unknown or other
  modified_base (192476)..(192573): a, c, t, g, unknown or other
  modified_base (798742)..(798751): a, c, t, g, unknown or other
aattggagcagttgtgattatgatcgcagcaatgggctatgttatttttagcgatgatgacgcgcatgttcaagccggcaatcaaacggtcgaacgaacaagcaccaaaacaactgctagtaaagaaaagaacagtcaaacaacaagcagcaaggcaaaggacaaagaaacacaagatcgtacatccaaacaattgccagatgttaaaacagacgattggcagctagttttggttggtccagatcacaaattagaaaaagaaatcgatgagtctactcaattggcatcattgagtaatggctatttgatcgacaaacgtattgctccggaatatgaagcatttgctaaagctgccgaagaagctgggtttccgttagttatggtttcagcttaccggtctgtatcatcccaacaacaagttttcgaacaaaatgtccaagatgtgatgagtcgccaaggtgtatcagaagaggaggcgacaaaaatcactaaagaaacgattacggagccaggatacagcgaacaccacacaggtctggcagtcgatgtcgtcgatcaaaactggtacaacagttatccttctactgtattggatgcaagttacggagatcagcctggagctaaatggattgcagagaatgctgcgcagtatggatttatcgttcgttatccaaaaggacgcgaagatataactaaaatcacatatgaaccttggcacttacgttatgtcggtaaagaaaatgctgagtatatcaccaaacaccaattgacgctagaagaatatctgaatgaattaaatgaaaagtaggaattgatcatggcgaaaaaaaagtggaaaaagcaaaagcgtaagaatatccgttggccagcagtggttgccggtgtagtagtgatactcctagcctttgttttttccttgaagaatctgtcttctccttttactgataatcagcaagaaaatgaagcgcaatcccatcagcaatttattgaacggcttgttccacatgcccaagaactacaagatggttatggagtgcttcctagtatcattttaggacaagctatattagaatcgaattggggaaaaagtaccttggctagcaaatacaataatcttttcgggatcaaggcttatggggatcagaagaaagtaagcctggaaacaaaggaatttgttaacgaagaatggataactatccaaggagacttcaaagtgtatgattcatgggaacagtccatggatgaccatacacaactgttcgtccaaggagtagattggaatcctgcactgtatgaaaaagtgattacggccaccaattatcaggaagccgcacaagcattgcaagatgcaggttatgcgacagaccccggttatgcgcaaaaaatcatccaggtcatcgagacgtaccagttgaatcagtatgaccggagatagcaaaggagaagtggctgatggcagaacaatttacgccggaaatcatgacggaattgagaaaagatatcgtaagagtaccggaaatcattttagaagcaagcgggatcaagatatttggaaaattgattcgttcgatcatctttactacggatatcgcaatcatacgaaatacaaatgcgaatgcagtaattgctgtgtatccttttacaccacatccagcaattactaaaagtatcattgaggcagctgatattccggttttttccggtgtaggaggcggattgacacaaggtgctcgttcttcttacatgagcatgtttgcagaagcgcaaggttctttaggggtcgttttgaatggtcctacacctttagagacagtgaaagaagtttgtcgagtagttgatatcccagttatcagtacggtaacatcgaaatatacagaaattgatgaaaagctagcagctggtatttcgattatcaatatcagtgcgggaaaagaaactgcagaagcagtacgtcattttcgtaaaaagtatcctgaacttcctattattgcgacaggcggaccaacggaagaaagtattgctgagaccattcaagcaggagcaaatgccatcacgtatacgccgccaagtagcggagagctttttagtcgtaaaatggaaaaatatcgggaaactgaaaaaggaaacatggataacaggtaagaagtagaggctgggacagaagcgtttaactccaagaaataaaaaggaattcacgaaatttgcttttcaaatttttgtgaatttcagcttatttccgaaggagttgcttctgcttccgccgtttatacgtatttagagcgtgagacaaaagtgttctttacttttgtcccacgctctttttccggttaaatggtgttctcttaccaattcctcggtcacaagtcacaatattcatcaaacatgggaagctgttttttttaaattgtttcttgtgactcggagctgaatggcaggctcgcgacctcttttatacttggtcctatttgttcgaaattcagaaataaaagaagatttttttgtttttttatctgtaatgtacatataaacggtcggaatatgttgttattattagctttacgtcaaaaaaatgtcttgatttattgaagcgctttctatagaatgaaaaacgaataaaaactaaaaaaggcacccggcaatttagtagcagctaaatcgccggggcttgaaaagtcagcgggaactgaccaatcaagttgccatagtcaatgcttgtgcatcgacgtgtatattgtacctaatttcatacagaattactagttatttttttgattttttagggaataatatacgcagagtggcacgcttatttagctatgtcaaggatattggacggttgtctgatatccttttttctttgcgcaattatcctcccatcattgaagcaagaagtgtttgtagcaatggaaaaagaatcagcactatctaattttccttgaaagtattgagttgttcatcctaggcagaacaaaaaggcaagccttggtttttattcgcctttaaaaaagatagttttataaatatatactgtataaaaatacagtatattgaaaaatgtcaatggaagtagaggtgtagaaaatgaagaaaaaaatgagaatcatcttagcattaagtgttatgttattattcttgacggcttgtgggcaagaggatgacgaaaaaatcacgttgaacatggcttggtggggttcacaagttcgacacgatgcaacggtaaaagtaatcgagctttacgaagaaaaaaatcctcatgtgacgatcgagtatgaattctatgattatgaaggatattacacaaaattaggtatgctagcagcatcaaatgatatctgggatatttttcaattaaataatcaatttcctcaatacatcaatcagattgaaccattagatgaatatgtggagcaagggataattgatgtttctaatgcagatgaatcctatttggcaacgacgatttacgacgggcaattagttggactgtccaacggggtgaactcgtttgcgattgcttacaataaaaatatatttgaacaattaggtatccctgaacctgcttccaattggacatgggaagaatttgaacaaatcagctatcaaatcactgaagaattagggatctatgctatttcaaggttcgaagattttatagctggctgtattattcaaataccgcaagttgagaaaggattgaatttttataatcaggaggatttatctaacagtttgggattcgaaaatccggattatttaacagattttttccaactgcgtaaaaatctggtagacaaaggtgcccatccagaaccgggtggtggagctgcaagtacgacagatctgtcttttcaggcagttagagatagcgaagcagcgatggtttttctatcaagtaaccagttgacagaaattttgtcaggcgctcctgaagacatggaaattcgattgattaatccccctcgcagaaaagcagatggagaatctggtattcctttacgttcttcgcaaatgctgagtatggcaaaaaattcagcacacaaagaagaagcggctaaatttattgatttcttccaaaacagtgaagaagccaatgagattttaaaaggagaacgcggtgtaccaatcatgtccaatattcgagaacaactcgctcagacagatgatacaactttacaagcgacattcgactatttagaaatgatctccgatatggacaacggtgaagtaaatgtttttgacagcgctttaaatccagagatccaagatcaatacaatcttttggtagaaaaagtcatctatgaagaaatgacggcagaagaagcagcagagagtctttatgagtttgcttcaaacattctggaatagtaacaggaggaaagcatgaaaaaagaaaaactaaaacgattcatgaatcaagataacgtggtcggttacgtatttgcttctccatttattctaggatttctattgataacggtaataccgataatcttgtctctttattattcgttcaccgattatcgtctggggaatccagtctcatggatcggcttggatagttatataaaaatgctaagtgatgctcgttttttgaactccattcgagttacttttctctatgtatttgcctctgtgcctgtgaaactgatctttggtctattgattgcttatcttttaacgagaaatatcaaaggaacgactttctttcgttctttgtattatgtacctagtttaattggcggcagtatttctattgctctagtgtggcgagaattgttttctaaaaatgggttagtgaatatttttctagaacgactaggcgcaccagcactttcctggtttggcgatcaaaaattggtcatgatccctcttgttttgatgtctgcttggcaattcggttcggcaatgatcatctttgctgcaggtatcaaagagatcccagcctcgtattatgaagcggcagagatcgatggagcgaacaaatggcagtcgttttacaagatcacgctacctcttctttcgccaatcattttgtatagcttggtcatgcagacgattgcagcgtttatgactttcacgcaagcgttcatcattacccaaggtggtccgaatgatgccacgaacttttatgctctttatgtgtataaccaagcattctcttttaattctatggggtatgctagtgctatttcgtggatcatgctgttgatcatgggtgctgtcacctttctgattttcaaatcatcaaaaaaatgggtcgttgtgtgaatggggaggaaaaaatgaataaaacagtaatgaaatggttccagtacgggtttattttgctattaggtctagtcatgatttatccagtcttatggatgatcgcaggttcttttaaaacggatcaagagattctgagtggttcactgaatttgattccagaaacttttcgatgggaaaattacgcagaaggatgggcaggttttgctggaatctcatttttcacgttctttaagaattcgtttgtcatctctgcggtatcaacgatcgggatagtgctgagctcgacttgtattgcttacgcattatcgaggatcgatttcaaaggaaaaaggttctggttcgtcgtcatgttagtaacgatgatgattcctgcacaagtgattttgattccgcagtttattatttacaatcggctgaatttggttggtacgtatgtgccgctgattttaccgcacttttttggacaagcattttttatttaccagatcatgcaattcatggttggtatccccaaagagttagatgaatctgcgattattgacggatgcagcaaatatagtgtctttaccaaaattatttttcctttgctgaaaccttcgatcatcaccacgatcattatccagttttattggaaatgggctgactttatgggaccgctgatctatttgaacaagccgagatcttataccgtatcgattgccatcaaattatttgcagatgctggatctagcacgacttacgccagtatgtttgcgatgtctacgctgtctctgctgccggtttttctgattttcttattcttcaataaatatctcgttcaaggaatcagtacaagcggcttgaaaggctgaatatgaaaaagccaatagaggagatgtttctttacaagatcaactactatttctgtcggatttttttaaccagtcttatcagtcatggtcttttcgctttttttctaggatgttttttcactttaggattaacgctttctgctcatgttatctatctgatttattttttgatgatgtatcctgcttattatctatctgcccattatttggcggaaaagaaggtaggttggcggaaagaaaaaatcaaaaggtcatgtttcattgttgcgttgtttcagctgttcgttcttatttttgcagctgattggtatttgttcatagaaaaggctgatgcttggtatctgattccttttctattgtgtctgttgctttttgtatcccatggtttttttagtacgctaattgatgtctgcaaagaagagaaagcagatagtcttatttatttgatcaaaaggaatatctggctgttgtcaaaaaacgtcaaagggtttctgtggtatttctgtcttttgtatgtgctgttttggtgtatacagtatgattttttacttgctgcattgctgtatcctggactgccgtttgtcacggcatgctggttaaaagaaaaggagaatgagtttaaatgaagaaaaaatatgtacaagtcggtcttggcggaagagctcgctttttttatgaggcaattgcctctacgtatcatcaaacttgtgaactggtcggtttttgtgatgtgtctcaaacaagaatggattatgcaaatcgagtacttgtgaacaagtatggacagaagaaagtaaagacatgtatgccatcgcaatttgaacagctactggatgatgtacagccagatgaagtcattattacgtcagtagatcgaacgcatcatgattatatcatccgtgcaatgagaaaagggtatgatgttatttgcgaaaaacctctgactattgatgaggaaaaagcgcaagaaataataactgtccaaaaacaaacgggaaggaatctgcgagtcactttcaattatcgttatgcgccatatcacacgaagataaaggaactgctggaaaaagacataatcggcgatgttttctctatccactttgaatggttgctgaacacgcagcacggggcagattatttcagaagatggcatcgaaataaacacaatagtggcggacttctcgtgcacaaatctacccatcattttgatctggtgaacttttggttgagtagccagccaaaaaaggtattcgcatttggtgaattgaatttttatggaatgcataatgcggaaaaacgcggagtagaaacattttatagtcgatgctatggaagcgaactagccaaaaatgatccatttgctatagatctatcagccaatgaggaattacgagaaatgtatttagaagcagaagaagacagtggatacattcgtgatcgcagtgtattttccgatgatatctctattgaagatacgttaggagtgacggtcaaatacgagactggtacgatattgacgtattcgctaaatgcgtatatgccgtgggaaggattcaatgtttcttttaatggcagcaaaggacggatcgaaatgaaagtgatcgaaaagtcctatatcaacgctggtggagataaaacagacgagggagcagccgttcttcagtccatccagctctatccgatgttcggtgaaccctatgaggtaatcgttgaacaagaagcaggcggacatggcggaggagatccacgtttgttggatgatctatttggcgaagcaaaggaagaagatccgtggaatcgagcagcaactcacgtagatggtatcctgtcgatcttgacaggaattgcagcaaatcactctattgcttcaggaaaagcagtgacgattgacgaacttgtcagcttcaaggaataagaaggaatttacgaaaattatttcctgtacgttataaatctgtgcgctattgccgtaggttgtctttggaacactatttattcgaaagaagggttgtgacacgttttttttcacaatcctttttgtgtggaatagaatttttggataagtgaaaataaaaataactatttaaacccgaacaaaaaggagtaatgcattaaaaatcattagattttacaaaaaaataagtaaaccacgttgtcagtttcagaaagtagtgttagactattttcaatatttgaaacaacattctttattcaaatatgtcaaactgccttcacgtgcaaaacagttgcaagaaaatgattttacactattattagttttacatacctacttatatatcgtcataatatggatgacagtttctagccagtaccgtaaatgctggactataagtaaaagattggctatttcacccttcttttcttatgataaagtggagggtgtttttctttaacagaaacatagtaggtttttgcacaaaagcggttttttggtattaataaatgataaaggagcaaataaagtgaaagaattagttgaacgtattcaaaaagacggacgtatattaggcgagggcgtactaaaagtcgacagtttcgtcactcaccaagtagaccctgtattgatggaacaaatgggacaacggtttgcagaagtatttaaagaacaagggatcacgaaagttgtgaccattgaagcttctgggatcgcaccagctttatttgctgcaaaagaattaggtgttccaatgatcttcgccagaaaagcaaaaagcttgacgatggatgaagaattattgacggcttctgtttattcttttacgaaacaagtgacaagtacgatttctatttctcgtaaattcttatcttcagaagataaagtattgattattgacgatttcttggcaaacggacaagcggcaaaaggattgattgaattatgccagcaagctggagctcaagtagaaggaatcgggatcgtcattgaaaagtctttccaagatggacgtcagttgcttgaagaaatgggattgagagtcgtttctcttgcacgtatcgcttccttgacgaatggacaagttgagtttcttgaggaggatgcataatcgtggaaaaagaaacacaaaatggaaaagccgcggttttagggctgcagcatctgttagcgatgtatgcaggagcagtagcggtgcctcttttgatcggtacaggactaggctttaatcaagaacagatgacttacttgatttcaattgatatctttatgtgtggattagcaacattattgcaattgaccgttaaccgatttttcggaattggcttgcctgttgttttaggatgtgcgatccaagcagtagcgccgctgatcttgatcggaactaatgaaggagtaggagctatttacggatctattatcgcttcaggtatctttgttgtgttagtttcaggtatcttttctaaaatcaagaaattattcccgcctttagtaacaggaacggttatcaccgttattggtttgacattgattccagtagcaattgaaaaaatgggtggcggtaatgcaacagcggctgattttggtgacaaaacaaatctactacttgcatttgtgacgattctcctcattgtaggtgtgcaaatgttggcaaaagggttcattcgttccatcgcggtattgattggtttagtcggtggaagcatcttagctgctttcatgggaatgatcgatctgagtgcgattggagatgcaccgttgttccatgtcccacaacccttttattttggtaagccaacttttgatgtatggtcgattttactgatgatcatcatttctatggtcagcatggtagaatcaacgggtgtatattttgcgcttggtgacattactggaaagaatgttggagaagaagaattgaaaaaaggatatcgtgcagaaggacttgccgttatcttaggcggtattttcaatacattcccttacacaggcttttctcaaaatgtcggattggttcaactttcgggtatcaaaacgagaaaacctatctacttctctgcgttcttcttgattgttttaggattattccctaaaatcggtgcgttagcacaaatcattcctgagccggtacttggtggaggaatgttagtcatgttcgggatggtggcagtccaaggaatccgtatgctgttggaagttgatttcagcaatgataaaaatctattgattgttgctgtttctgttggatttgggctaggtttcaatattacgccgacattattcagtcaaatgcctcaaacattgcaaatgttcactggcaatggcatcgtaatgagtagtattacggcgatcatattgaatctgatctttaatggtttaaaaaaagatgaagaaatagtagaagaagccttcaaaaaataatgaagtaaaagaaaagttgtgaaaccagcgttttgagtgaatagcgaggatcagctgattgaataccatttatattaaaaaaggatgtgacatcacttttgttacattctttttttatgccttcgacaaacacgaacaataaaatggttttctttatcaatattcgaaatttctttgacatcaaaaaatacgattgttaaaatatgggtgtagaaaaactgggaggaaaaacaatgacagcaaaaatctctgtgattatggggagtacttcagattgggaaacaatgaaagaagcatgtcaaatattggaagaattcggtgtgtcttatgataaaaaagtcgtttctgctcatcgcacaccagatttgatgtttgaatatgcacaaagcgctcgagaaaaaggaatcaaaatcattattgcaggagcaggtggagccgcccatctaccggggatggttgcggcaaaaacaactttgccggttatcggcgtaccggtccaatcacgaacattaaatggtttagattcgcttctgtcgattgttcaaatgcctggaggcgtgcctgtggctactacggcaatcggaaaagctggagcaattaatgctggactacttgcgatacagatgctttccatgtatgatttagaattggaggctaaattggctgaaagacgttcaatgttggctaaaactgttatagaaagtagtgatcaacttggttaaacctttgttgcctggttcaacgatcgggatcgtcggcggcggtcaattaggtcgtatgatggcgattagtgcaaaagaaatgggctttaaagtaggtgtgctggatcctgtaagtgattgtccagccgcacaagttgcagattggcacattgaaagtgtctatgatgacacctttgcgctgaaagagcttgctagaagaacagatgtcattacctatgaatttgaaaatgtcagtgtagaggcgctaaatgcgatcttacccatgtcatttattcctcaagggacagacttgcttgcgattacgcaagaccgcctattggaaaaatcttttttggaaacgaacaacatcgtgattgctccttatgcaacgatcgtcagtccgacagatatccaagatgcgattgacgggatcggttatccttgcgttttgaaaaccactcgaggcggttatgatggcaaagggcagtatgttttgaaaagtcgtgcagacttggcccctgcaatggatcttttaagagaaggaacctgtgttttagaagcttggatcccatttgaaaaagagatttcgatcatggtggcaggaaatggacaaggagatttcacaacttttccggtcgtggaaaacatccatcgaaacaacattctgcacgaaacgattgctccagccgcgattgatcaggatgtgattgaggaggctgagcgtattgcccgtgtgattgcagaagcagtaagcctttcaggtgctctaggggtagaaatgtttttaacaaaaacaggcgggctatatgtgaatgaattagcccctcgtcctcacaattctgggcattattctatcgaagcttgttctatgagtcagttcgatgcccatattcgaggtatttgcggctggccattaggagaaaaagtgcgtctgacaagcaatgcagtgatggtcaatgttttgggagaacaactgttggaaagctatcgcttgattgagaataagccagactggcaattccatttctatggaaaaaaacaagcgaaaaaaggtcgcaagatgggacatatcactatcttgacagaagacatccagcaaacgctggaagaaatcaaacaaacgaatatttgggattagaggagaaaaaacatgttagaacgttatacacgccctgaaatggggaatatctggacggaagagaacaaataccgtgcgtggctcgaagtcgagattttagcagatgaagcttgggcagaacttggtgaaatcccgcaagaagatgtgaaaaaaatccgcgagcatgcatcatttgatatcgatcgtatcttggaaatcgaaaaatcaacacgccatgatgtcgttgcttttacacgagcagtttctgaaacattgggagaagaaagaaaatgggtccattatggtctaacaagtacggatgtcgtagatactgcttatggctatctcatcaagcaagcaaatgatattttacgggaagacttgaaacgttttacggaaatcattggcgaaaaagcaaaagaacacaaatatacagtgatgatgggccgaacacacggtgtccatgcggaaccaactacttttggattgaaacttgccacatggtattcagaaatgaaacggaacatcgaacgattcgaacatgtggcaaaaggagtagaagcaggaaaaatttcaggagcagtggggacgttcgcaaatatcccaccatttattgaagagtatgtatgtaaacaattggggatccgtccgcaagaaatctctactcaagttctccctcgggatctacatgctgaatatttctcagcgatggcacttattgctacaagtattgaacgctttgcaacagagatacgcggattgcaaaagtctgaaacacgtgaagtagaagagttttttgcgaaaggtcaaaaaggttcttctgctatgccgcacaaaaggaatccgatcggttcagaaaatatggctggtctagccagagtggtgcgtggacacatggtcactgcctatgaaaatgtcacgttatggcatgaaagagatatttctcattcttcagccgaacgaatcatcttgcctgataccacgattttattgaattacatgttaaatcgttttggcaatatcgttaaaaatctaacggtctttcctgaaaacatgaagcggaatatgtctgcaacatttggtttgatttatagccagcgcgttatgctgaaattgattgataagggaatgacaagagaagaagcttatgatcttgttcagccaaaaactgcgtatgcttgggacaaccaagttcagttccgcccgctgttagaagaagatccgaccatcacatcggtcttatctaaagaagaaatagacgatgcctttgattatcatcatcatttgaaaaacgttgacgtgatattcaaacgagtaggtttggaataaagaagagtgagttgcaaaattcaattaaaatagaatagcaaaaataaccaaaaaagaagcagatccgttagcggttctgcttcttttagtttattatgttttcttatcaatgataggaacctgattttaaaagcgactacctctttaccgtgcctctttacatacaaaaaatagaggaattaagcgtaaatggcttggctattataactaaaatgctggttatggagatattgcagcaaattttcgagaaaagcatattccatctcttgtccattaaataagatctggatacgatagtgatttttgaaacgtttctgctcgtggatctgactgattaaaagttcgcctttgtgttctgtccgataactaaaagtccttttacggcattcagcgcaacgcttagctgctcggcggattttccgaaaggtataaaaactagtatctttattgcataaataaacgtctttgatcgacaataaatcattatatagacaggaacgttcttcagccgttaattctgataaaaaaagctgaccttgttttattgcatcttccatcggcaagtgcctcctcgatccagttatccaaatttttagttaattttaatataccatcattatatataaatgtaaacgcttgttgatgaggggatttttgtacttataacaaaacacgaacattaaaagaatctaatgcctttaatgtacatatttatattgatttctaaaaagatgattgttaaaattcaaagtgaaaacacgaacaaaaatcgatgtatttgctttcaatgtaaacaaaaaggagagtcagacatggagaaaaaagaacttctgtacgaagggaaagccaaaaaattatatcttacctctgatgaaaacttgatttgggtagaatacttagatcaggcgactgcgttgaatggcgcgaggaaagatcagataagtgggaaaggagaattgaataatcaaatcacaagtacgattttccgctatctgacccagcgaggaataaaaaatcattttattgaacaattatctaaaaccgaacaattagtaaaaaaagtacaaatcatccctctggaagtggttatccgaaatattgcagcaggaagtttctcaaaacgtctaggtgttcctgaaggcaaaaaattaatcgagccaatcgttgaattctactataaggatgatcagttggatgatccttttgtcaatgaagaccatatctattacttgcaactggcaaaaccggaagaaatcagtgagctgaaaacccaagcattagctatcaataaaattttgatcgaattattcgctaaggttggtctggttttagtggatttcaagcttgagtttggtcggtcgaatggaaaaatgttgcttgcggacgaagtaacaccggatacttgccgattatgggatgaacgtacgaatgaacatatggacaaagacgtttaccgcagaggcttaggtgatctgattccagtctatcaagaagtatataaccgtctatcggaactaactgaagaaaaggagcgagtatgatgtatttcgtaaaagtttatataacctataaagattcagtgttagatcctcaaggagaggcagtaaaaaaagcagtccatcgtatgggatatgaaacaatcgaagatatccgtatcggaaaatactttgagatacaacttgctgatacagaagaaccaatcgatacagtgattgaaacgatttgtgacaagttgcttgcaaatgtaaatatggaaacataccgatatgaaatcaaaaaaatggaggaagtataacatgaaatttgcggtcatcgtttttccgggttcaaattgtgacgcagatatgttatgggcagttcgcgagattatgggcgctgatgccgaatttgtacggcatgatgagtcctctttagaaggttttgatggggttttactgccgggaggattctcctatggtgactatttgagatgcggtgcgattgctcggttttctacaatcatggaagaagtgattcgttttgctgaagaagggaaacccgtattcggtacatgtaatggattccagatattgacagaagctggactgttgccaggtgtactgagacgaaatgagtctttgcattttatttgtaaaactgtaccattgaaagtcaaccctaagacagcctttacttcagaatatgaagcagatgaaataatctctcttccagttgctcacggggaaggaaattatttctgtgacgaagaaacacttgaagaactgaaggaaaataatcagatcgtctttacttataatgacaacatcaacggcagcgtggaaaacattgcagggattacgaataaagcggggaatgtgttaggaatgatgcctcatccagaacgtgcagtagaagacttgctaggatcagaagatgggaaacggttctttgcttccattttaaaaaacttcggaaaggtgaccgtatagatgaaaacattgaatgaaccgacagctgaagagatcaagaaaaaaagaatctatgccgaatggggattgactgatgaagaatatcgaatgatcgaagaagatatcttaggaagaatgcctaattatacggaaactggactgttttctgttatgtggagcgaacattgttcctataaaaattctaaaccggttctacgcaaatttcctactagtggacctcatgtcttgcaaggccccggagaaggcgcaggtatcgtcgacatcggtgatggactagcagttgtcttcaaagcagaaagtcacaaccatccctcagccgtggagccttatgaaggagctgcgacaggagttggcggaatcatcagagatattttcagcatgggggctcgtccaattgcgctgctagattcattgagattcggcgaattagataatccaagaacaaaatatttactagaagaagtagttgcaggtatcggcggatacggcaattgtatcggcataccgactgtaggtggcgaaattgcatttgatccttgttatgaaggaaatccattagtcaatgcaatgtgtgtaggtttgattgaacacaaatatatccagaaagggcaagccgctggtgtcggcaattcgatcatgtatgtaggagcaaaaacaggtcgcgacggcatccacggcgcaacttttgcctcagaagaatttagtcaagaagaagaacagcaacgttctgctgtacaagtaggcgatccttttatggaaaagctgctgcttgaagcgtgtttggaattaatcttgcatcattcggattctctagtaggtatacaggatatgggagcagcaggacttgtttcatctagtgcggaaatggcttcaaaagctggttcaggacttatattgacattagacgaagtcccacaaagagaaactggaatgacgccttatgaaatgatgctatcggaatcccaagaacggatgttgatttgtgtcaaatcaggagaggaagaaaaaatccaagaactatttcagaagtatgatctagatgcagtcactatcggtaaagtaacagacgacgggcaatatcgtctatatcatcaagggaaagaagtagcgaatctgccagtcgatgcgctggctgaagatgcgccagtctatcataaagagatgaaagaaccagctcgaatcgcagattttcagcggttggctccttatcagccggttattgaagaacctggacaagtattgcttgatctgctgcaacaaccgacgattgcttcgaaacgttcaatctacgaaacttatgattcacaagtacaaaccaatacagttgtctgtccaggaagcgatgcggctgtgatgagagtcagagggacgaacaaagcattagcgatgaccacagactgcaacgctcgttatctctatttggatccaaaagtcggaggacaaatagcagtggcagaagcagctagaaatatcattgctagcggtggcagacccttggcgatcaccgactgcctgaactatggttctcctgataaaccagaagttttttgggaattatcgacttcagctgacggcattgctgctgcgtgtgaaacgttaggaactcctgttatttcaggaaatgtctctttatataatgaaacggacggtcaagcaatctatccaacaccgatgatcggtatggtcggattgatcgaggatcatgaacatatcactactcaggaattcaaaaaatcaggggatctaatctatatattaggcaagacgtttgcagattttgatggcagtgaattacaaaagatgcagcttggaagaatcgaaggggtgattcgaaactttgatctagccgttgaaaagaaaaaccaggagttagtattgacagccatccaaaacggattgattgaaagtgcccatgactgttcagaaggtggcttggcaattgcactggcagaatcagctttcaaatatcagttaggtttatctgtgcagtttggcttgccctctgctcaattgtttgcagaaactcaatcaagatttgtattgacagttgcaccggaaaaccagacacgattcgaagaaatgatgggagatgctgctgttttagcaggtaaggtgacggatgaagcgataatcgaaatttcagcaactgacggtcaaatcaaaatagaaacagcagtagcaagaaagtgctgggaggatgcaatcgtatgtcttatgaagtgaagagtttaaatgaagaatgcgggatcttcggtgtttggggtcatccagacgccgctagtgtggcatacttcgggctccatagtcttcagcatcgaggacaagaaggtgcgggtatcgtgtccaatgatcgaggaaagctcatgggtcatcgagacctgggtctactttctgaggtattcaaagatcaaagaaaattgcagcagttaacaggagaagctgcaatcggacatgtacgttatgcaacagcaggcaatggaagtgtggacaatattcagccttttctattcaaatttcatgatcagtcgatcggcttagcgcataatggtaacttgatcaatgctcgctctcttagaaaagagttagaggaaaatggggcgatcttccattccaactccgatacggagatattgatgcatttgatccgacgaagtgaagaaacagattttttaaataaattgaaaagtgctttaaatgaagtcaaaggtggctttgcctatttattaatgacagaaacggcaatgattgccgctttggacccgaatggttttcgtccattagcaatcggacaaatgaaaaacggagcatacgtgattgcctcggaaacttgtgcattagaagttattggggcacgttttataagagatgtccagcctggtgagatagtgatcatcaatgacaaaggaatccagattgattgctttacgaaggacacgcagctttctatttgttcgatggaatatatctattttgccagaccggattcaaatatcgcagggatcaatgtgcatactgcacggaaaaacatgggacggaatttagcgaaagaatcgccagtaaaagcagacatggtcgttggtgtacctaattcttctttgtcagccgcaagcggttatgcagaagcaagcggtatcccttacgaaattggattagtaaaaaatcaatacattgcccgaacatttatccagccgacgccagaactaagagagcaaggcgtccgaatgaaattatctgctgtacgcggggtagtggaagggaaaaaggtgattatggttgatgattcgatcgttcggggcacgacaagcagacggatcgtccatcttttgaaagaagcaggagcaaaagaagtacatgtgaggattgcttctcctcctttgaaatatccgtgtttttatgggattgatattcaaacgcgtaaagaactcattgcggccaatcacacgattgatgaaatcaaagaatgtatcggtgccgattctttaggttttttaagtgaagagggcctgatcgaatcgatcggtctggaaaaagatgccccgtattcaggattatgtatggcttatttcaacggagattatccgacgccgttatatgactatgaagaaaaatatcaggaatcactaaaagaaaaagtatcgttcttttaaaagcagatcaagaagggagtatatgaagccaatggcaaatgcatacgcaaaagctggcgtagatgtcgaagctggatatgaagtagtagaacggatcaagaagcatgtcagaaaaacggaacgattaggcgtgatgggcgctataggaggattcggcggctgtttcgatttatcggtctttcaattaaaagagccagtccttgtttcggggaccgatggtgtagggacgaaattagcagtagcaatcgaagcagacaaacacgacacgatcggaatcgactgcgtagcgatgtgtgtcaatgatatcttagcacaaggggcagagccgttgtattttttagattacttagcaacggggaaaaatgatccgacacgtttagaaaatgtagtaaaaggtgtagcagatgggtgtgttcaaggaaatatggcactgatcggcggcgagacagctgaaatgcccggtatgtactcaggaaatgattatgatctagccggatttgctgtagggatagctgaaaaatctcaattattgacaggagaaacaatcaacccaggagacgtgttgcttggaatagcatctagcggaatccattcaaatgggtactctcttgttcgcaaaattttctttgagcagcagcagttttctttatcatcaaacctgccagaattgaaaaaaacacttggcgaagtattacttgaaccaacgaaaatctatgtttctgccttgcttccgctgatcaaagaaaagaaaatcaaaggagctgcacatatcaccggtggagggtttgtagaaaatatcccgcgaatgttgccagaatctatggctgctgaaatcaaacttggcacgtggccgatccttccgatcttcggctgtttacaaaaatatggtgagattcctatgatggagatgtacgaaatattcaatatgggcatcggtatggtcttagcagtcgaggaagcaaaagtaaaagaaatcgtgcacgagattgagcaagctggcgaaaaagtttatgaaatcgggaaagtgatcgccaaagaaaaacatcgtgtggtgtttacaggagaagaacgatgaggatcgctgtttttgcttctggaaacggaagcaactttcaagcgctagccgattatctatcgaaaaaaggaatggaagcttcgattgattggttgttttgtgatcagcctgcagcatatgttttgaaacgtgcagtcgcattggatgtaccggcagattgttttttacctaaagaatttgactccaaaaaagagtatgaagaagcgattttgtataaattgaaagaaaaaaagatcgatttgatcgtattagctggatacatgcgaatcattggaccagtattgctggaaaattatgataaaagaatcatcaatatccatccatctcttttacctgcatttcctggtttgcatggcattcgtgatgcatttgaagctggagtaaaagaaacgggtgtcacaattcattatatcgaccaaggtgtagatactggaccaatcatccggcaggaaaaagtgaggatcgaacaggaggacacgttcgattctttaaaagaaaaaatccatagagtagaacatcgaatctatccagaagtgattagtgaaattattgaaaatggaggctatctgaaatgacaagagcattgatcagtgtatcagataaaactgggattgtagcatttgcccaaggtttggttgaacaaggagtagaaatcatttcaacaggaggaacaaagcatacgttggatcaagctgggatcaaaacgctttcgatcgaagaagtgacagggtttcctgaaatgatggatggccgtgtcaaaacacttcatcctaaaatccatggtggtcttttaggaagacgcgatctctctagccatatggaggcaatggagacggaaaatatccaaccaatcgactttgtttgtgtcaatttatatcctttcaaagaaacgattatgaaaccagatgtcgaaatagcagaagttattgaaaacattgatataggtggtcctagtatgctccgtagtgcagcaaaaaaccatgaatttgtcaccgctgttgttgatccatctgactatgaagaaatactttcagaattacgtcagtatgggcatacttcactttctttcagacaaaaactagcggcaaaagtctttcgtcatactgctgcatatgatgcactgatcgctcaatacttgacggattgggtggaagaaaaagaaccggaaaaattgacacttacgtatgaacgaaaacaaacgcttcgttacggtgaaaatagccatcaagccgctgccttttatcagtccgctcttctggaaaaatattcgattgcagcagcaaaacaactccatgggaaagaactttcttataataatatccgagatgcagatgctgcgttacggatcatgaaggaatatgacgaaccaacggtagtcgccttgaaacacatgaatccttgtggtattgggacagcatctacgattttagaagcgtgggaagcagcatatgaagcagatcctgtttcaatctttggtgggatcatcgttttgaatcgagaagtagatctgccaacagcagaacagatgcataagctgtttctagaaatcatcattgccccttcttatacacaagaagctttggaattactgcaaaaaaagaaaaacatccgattactgacagtagactttgcgcaagaagaaaatcaaaatcgagaagaaacggtctcagtcttaggtggacttcttgtacaagatcaagatctggcaatggaaaacgaagaagaatggaaagtcgtgacaaaacgtaagccgactccagcagaagcaaaagcattagcgtttgcttggaaagctgtcaaacatgtgaaatctaatgcgatcgtactggcaaacgaacgtcagacagtaggaatcggagccgggcagatgaatcgagtcggttcagtaaaaattgcgattgaacaagcgcaagagaaaatggaaggtgcagttttagctagcgatgcttatttcccaatggatgattcagttgaatatgcagccaaacatggtataaaagcaatcattcagccaggtggaagtatcaaagaccaagattctattgatatggcgaataaatacgatctagcaatggtctttactgatgttcggcattttagacattagagaggagtcggataaatgaacattttggtgatcggtgcaggtggtcgtgaacatgcaataagtaaaaaacttttagacagtccgaaggtggatactgtgtattgtgcgccaggaaatcctggaatgacaaaggatggcatcaattgtgtcgctatcagtgaacaagatcattcagcattaattcattttgttaagaatgaggcgattgattggagtatcgttggtcctgaagttcctttattaaatgggatcgtcgatgattttatggcggaaggattgaaaatcttcggtccgacaaaagcagcagctctgatcgaaggttcgaaaagttttgctaaacaattgatggagacgtatcagatcccgacagctaaatccagaagttttgaatgttacgaaaaagcggcagcgtatatcaaagaaaacggtgcgccaatcgtagtgaaagcggatggcttagcagctggaaaaggtgtagtcgtggctacaacagtgaaagaagcgctggatgcggcagaacaaatgttgaaccagcatcgatttgggaacagcagcaaaaaaatcgtcgtagaagagtttttggcaggagaagaattctcccttttggcgtttgtccgtgataccaaggtgtatccgatggtcatttcgcaagatcataagcgggcattcgataacgataaagggccaaatacaggcggaatgggtgcttattcaccagtaccgcaaattccaaaaaagatgattgaaaaagctgtggaagaagttttaaaaccagcggctttgggaatgaaagaactaggacgctctttcacgggtgttttatatgcgggtttgattgctacgaaggaaggaccaaaagtgatcgaattcaatgcacgtttcggtgatcctgaaacgcaagtcgttctttctcggttgaagagtgactttgcacaagtaatcgatgatttattagagaatcgtgcagtagagttaaagtggcagcaagaaggatacaatgtaggcgttgtggtggcagctgccggttaccccgaagaatatgagacaggaatggttctaccagattttctggaagaagagctttctgtttactatgctggagtttcctcaaataacggcaaactagttggaacaggaggacgcctttatctagtagaagcatacggtgagacgatcaaagaagcacaggaaaaaatctacaccgcgttaatggataaaacgacagatggaacattttatcgtacagatattggagaaaaagctgccaatagcgaactagtcgtgaagtaaatcagctgcttctatttataaaaaaatacaacaaatatagtcggaagcgccgattttagtgaagccttttcataaagagtgtggtacacttttgttgtgtatataaataaggaggagttcagatgaaaaaaattcaattaggtacttctgatcagaaagcagctgcagtgatcttaggctgtatgcgtatcaacaatgcggaagatccagtaaaagtgattgagacagcttatgaaaacggcattgatttttttgaccatgcagatatttatgggaacggtaaatgtgaagaaatctttgcagatgctctagcaaaaacatcaatcaaacgagaagatctttttattcaaacaaaatgtggaatcgttccaggtgtgatgtttgatttttctaaaaaacatatcattgaatcagtggaaaaaagtttgacccgtctgaaaatggattatgtggatgctttacttcttcatcgtccagatacattggtggaaccagaagaggtagctgaagcgtttgatgaattggaacgatcaggtaaagtccgttattttggtgtcagcaatcaaaaaccaatgcaaatcgaattgctgaaaaaatatgttcgtcaaccattagtagctaatcagctgcaatttggcttgaaacatactggaatgatcgatcaagggatccatgtcaatatgacagatgaagcaagtatcgaccatgatggtagtgtacttgattattcccgtctgcatgatatgacgatccaagcgtggtcgccataccagtatggattttttgaaggtgtatttatcgggaacgaaaaattccctgaattaaaccaaacattagaagaactcgcagctaaatatcaaacgacaccaactggcttggcttctgcttggattttgcgccatccagccaatatgcaagtaatcgccggtacgatgaacgtagggcgaatcaaggaaatcgctcaagcatcagaaattaatatgtctcgggaagattggtacgaattgtaccgcgctgctggaaacattttaccttaaaagttgtcataagcaggtgaacgttgcgatcaattaaaaaggcggaatatcttgaaagctattttcagcttcgagatattccgcctttttttattgccaacgggaaagagtatcgctatacggattttatttattatttatttttgttttcaaggaaaagctgtgtccgatattcttttggggaaatcccttgttttttcttaaataaataactgaaatagttagggtcattataaccaatctcaaaagcaatatctgagatacgatagtctgattgctgcaataatttttttgctaattcgattctttgttctgtcagataatcgatgaatgtttggttaaacgattgagaaaaaatcgtactgaaatgagaggggcttaatgcaacttgttgagcgacccaagttaaggacatatctggatcggtaaaattttctttgataaaatccaatgcatggttcaaaattggctgatatttgttctttgaaggctgtgagggcagagcagttaagaaagaaatgaacatagaaacagtcgaacggtaaagcgagtcgtcggcgctgattgctaagcgttggctagtggctgtgcaatgaaccatttcttgcgggatttccttttctttcaggcggacatgctggagtagcttagtcaagacaaataaacgatataatcgtgttcggattggtgtgccttgtggtttcgtcaagtgttcgatgtacttagatacttcgtttttcgataatgaagacaaatcaagtgagagatcaaagtaaaagacagaatcaactggaagttttgcttctttaatcaaatcctcatagctgataatttgatctttaagggaactggcagtttcaagtatcatctgcgtgatctcaaaagatgtaggtaattcgctgattctttctgcgacaggaccgatggcgactgaaaaattatttttttgtcccttttctaattcatggaccaacgtttgggctacctgataactggtctcaatcacattttcttcaagaggatcaactattaaaaatttgatgaatcgagaggaaacagcagaaaaaatcacttgttgattctccctaaataaaaacttcaaataatcactgagatgagcgtaatcttcaaagtctgtactgacttggtttgctgctaataatacggtcatttttttccctgctaaagagcgattgaaagattcagcaagtttcaatgtttcactgatcgtaagtgagcctttgaacaaaccgttcaagaaatgattttttttcaattcgaaaacaagatcagaagaaggctgcgtttctttttgctgcaagtctaacgcagtcactgctttttctattgcttgtttcaattcgttgcttttaattggtttaagtagataatcatctgcctgtacttggattgctcctttcatataatcgaaatcgtcgaatccgctaataaatatgaggcgagtccaaggaagcagtttccttgcttcttttgaaaaagtcaaaccgtccatgaatggcatttggatatcagtcagaatgatatcgggctgtaagtcgataatcgaagacagtgccatctcaccatctccagcttccccgacataagtgattggataataagaaccaagggcagttatttgttcccgcaagttattgcgaatgaggtattcgtcttcgatgataaaaactttatacatgtttgtttcctccaattgttttgggagatataggaatcgtcagtgtgacagttgtcccttctcggtatttgctgtcaatcgtgataggtttttgattatttccgtaatagagaaggagacgcttgtttacgttgtaaagcccgtagccgatactgaaatctgaatcgatccctttggctaactctttacgtatttctgctagtttttctacaggaatgccaataccgttgtctatgactttgaattggatcatttcgtcgattttgcatgcagtaatacgaataaatcctttgtgacgaacgtactttgttccatggtacacagcattttcgatcaatggttgcaagatcatctttaaaatagaaacaggaaaaagtgtttctggtatatcgatcttatagtcaagcatatgtccgtatcttatttttaaaatgaccagataatcattgatatggctgatttctttttcaagaggaatccagtcttgtcctttgcttaaagacgtacgaaaaaagccggaaagtgcatgggtcatagtcagagcttcttcaaagcagtcttgttcgatcaaagaaatgatggcatccaaactgttataaataaaatgaggagtgatctgagcttgcaatacacgaacttcactttgtgctaaatggtattgtttcaaagcgttctcccgtaaagactggtttagatcttccgccattttgttcatactagcggtaagtgtctgtagttcttgtgtttctggcatgtttaaacgaaatccaagatctcctgaagaaagctgttcggacattgtgatcagctgattgatcggctcttggaccttctgctctaaaaagcggcgattctttttcgcatagaaaaaaatagtactaagaacccccaattcgactatcgttaataaaatgagcgagcggacaagcgtcgtatttttttgacttgctaagtcgatttccacacgaacaaaatcctgtaaaatatctgacagtagttgagtgacagaatcgacctgattgatgatctgttcattggtatccataaaatcttctgccaagatatgatgaatgagctcagtttgataatcttccaatgtatcgatcgtacgtaacgatacatctaacgtactaatttctttaagtgtatttgtattatttttgatctctcgaatatcattcctaagttcttctaggatattttcctcattgaactcatctacggttacttggccagaaatcaagtcccacatactttccaaaactttttgatcaaccttcaaagcaattgcatctgctttttggatatttgcgatcgtctgttgataaatcaaaagctgttgcgaatataacagtatgctcagtagcaaagggataacagcaaatagaagcatggctttgtttgcttgggcaaaaatctgttttatgcttaaatttttggtcatgatacttctccagtcaataatttctggttgggatgttagctatattctgctgggaaaagacagtctcggaaataaaaatatctttaggtaatgtttttcctgtttgaagatttccaaaataacgagtaacggtattggctacataccagccgacatcaggtttacactcgactacgcaattgacgattcctgagcgtagcttctcgatcatatcttcttgtccatcaatcgttacaatgatcaaatcttctccaggtttgattgatgtttcttttatcgcagctaaagcaccgtgagtcatttcatcactatggctgtataatacatcaatttcggataaatcatttgtttctaaatatcgtttcatctggtcttttcctttcatccgaataaaatcaccgacaattcggtgaacaatagtcattggaggtttatggtcgatggttccatctttttttagggttggtttacgattgattgattccaaaaatccttcggagcgtagcttggtcggtgtggagttctctgaaccagcaagttctaggattctgatttcctgtttctttgaatttgtgaagtgattgctgacaaataaacccgcccgatttccttctgctttgaaactgggaccgatgtgggtgacgaaaagctcgggatcattcgtttgaatatgtctgtcgacaagtatgacagggatccctgctcgcttggcttcttttaatacagagtcccacccggattcttgcaaaggagtaaaaatgatcatatctactttataggcaatgaacgtccgtatatcttggatttgccgttcctgattcatgtaaccatttcggtagagaacttggtaatcttctttttcaagcgcagtgataattgattcagtatgctttttccgccagctactctccgttcctgattgcgaaaaaccaacgactagtgggtcaggtgcttcctttgtactaggtgtacaccctatcatttggtaagcgattacaataagggctaaaaaaaaataaaacacgtttcactttagatcactccatctggatttgttagtactatcttatcagataaaagggaaaatcaaagtcaaaaggaatcaatcgaaaaaaatccaagaaacttaaaaaaatccaagacaaaaaaagtgcacctaaaaaatttaaagtaaatcccataaaaaaatcaatgttaacgctttctttattagctatactcggtgtatcaatcggaatgggggataaaaaatgaaaaacaaatttagaaagattcttgggagtatcgctattttgaccgcaagcattctattaagtgcgtgtggcaattcaggatctgcagatgatagtacggggtatgtaggaatcgctatgccgaccaaatcagcagaaagatggatcgctgatgggaacaacatggtctcggaattagaaaaactgggttataaaacagatcttcaatatggagaagataaagtagaaaatcaagtagcacaaatcgaaaatatgattacaaaaggggtagataaacttgtgattgcttctatcgatggttcggctttaactgatgtgttagctaaagcaaaagaagcagatatcaaggtgattgcctatgatcgtttactgatgaattcagaaaatgtcgattactacgcgacttttgataattttggagtaggtgtatcgcaagcagcttatattgaggagcacttaggattgaaagaaggaaaagggccattcacgattgaattatttggtggctcgcctgacgacaacaatgcactaattaattacaacggagtgatgtctgttttacaaccatatatggacaacggtcagttggtcgtgccatctggacagacgagtttcagtcaaatcgctacgcttcgctgggatggttctacggcgcaagcaaggatggataatctgttaagcgcaaattatactgaccaaacattggatgctgttttgtcgccatatgacccaataagtttagggatcatttcgtcattaaaaggcgtggggtatgggagtgaaagtaaacctttacctgtgattactggataagatgcgacagtagctggcgtcaaatcgatcattgccggggaacaaacacaaacgatctttaaagacacacgtatcttagcaaaaaatacgattgaaatgatcaaagcaatcagtgatggagaagaggttccggtcaatgatactgaaacttatgataatggggtgaaaactgttcctacgtatttagcaaatacagtatctgtcgataaagataattatcaagcagagctgatcgacacagattattataaagaatccgatctgaaaaattaagaggaaccaaacaaggaactaaagagatctaagtcagagagaggataagaattatggcggattgtattttaaaaatggcagatatcaccaaaaaattttctggaatccgagcgttagattgcgtgaatctgatgattgaacgtggggaaatccatgcattgtgcggagaaaacggaacgggaaaatcaacattgatgaatgtcttgagcggcttgtatccatatggctcctatgacgggaaaatcttttatgatggaaagctgtgtcaattcaaagatttgaaagatagtgaagaaaaaggcatcgtcatcattcatcaagaattagcactaagtccttatctttcaataaaagagaatatttttctcggaaatgaacaagcagaaagaggcgtgattgattgggaactgacagaaaagaaaacgtatgaattgctgaataaagtcggtttgtctatcgacccgaatcttctagtatcccagatcggcgtagggcaacagcaactagttgaaatagctaaagcattatcaaaatccgtccgtctgttgattttggatgagcctaccgctgcattgaatgaagaagaaagcgcgaatttgctgagattgatccgagaattgaaagagcaaggtgtaacctccatcattatttcacataagctgaatgaaatcgtggatatcgcagatcgaatcaccattttacgggatggacagacgattgagacgctagaaaatgaaatgatcagcgaagagcatattattcgcgggatggtgggcagagatttagttgatcgttatcctgaaagaaaaccggatattggagaagtttattttaaagtagaagactggacggtctatcaccctcttgatcatgagcgaatcataaacgaccatatcaacttgcatttgaaaaaaggagagattgtaggaatagctgggctgatgggagcgggcagaactgaattcgctatgagtctatttggacattcttatggaagcaagatatccggacgtatattaaaggaaggggcagagatatcagttaagaccgttccttcagccattgcaaacggactcgcttatgtctcggaggatcgaaaatctttaggactgaatctgctgatggatattcgggaaaacgtgacgctgagcagtttggataaaataagtcaaaaaggagtattagataaagaaaaagaagtaactgaggcagaaaatttccggaaaaagatgcgtataaaaacaaactccatccatcaaattgtcagtagtcttagtggtgggaatcaacaaaaagtcgttttatccaagtggctgatgacacaacccgatattctttttttagatgagccaacccgagggatagacgttggggcaaaatatgagatctacacgattatcgaagaaatggcagcaaatggcaaagctgtctgtcttatctcttctgaacttcctgaaatcttaggaatgtgtgatcgaatctatacgatgaacgaaggacgtattacaggagaagtctcgcgagaagaggcagatcaagaagtcttgatgaaattaatgacgaaagaagaggtgggttaagttggaacaagcaaaaaatcttacggataaaaaagagaaaaaactaaatttgaaaagtagagcagctgatctttttggtcgctacagcatggtgatcattttagcgggactacttattgcgtttcaattgatgacggatggtattttctggcgtccgttgaatataactaaccttgttttgcaaaatagtcatatattagtactagctgcagggatgttattagttgtgctcttaggtcatgtggatttgtcggtagggtcagtgatggcgtttgttggtgcaattgcgggcatgatgatggtcaatcgccaaatgaacccgtgggtgacagtcatcgcatgtcttgcagtaggcgggctgatcggcgcatggcaaggtttttgggtagcttatgctgggataccggcgtttatcgtgactttagcaggattgctgatgtttcgtggactgacacaagttgttctaggcggtcaatctctagcaccttttccagctgttttccaaaaaatgtctacgggttatttaccagacttaagcgaaggaagcagccttcacttcttgacattgattttaggaatgatcatcaccatcgtgttagttgttggacaatggcgaacaagaaatcgtcggaaaaatcatttatttgaagtggaatctccagcagctttcttggtaaaggcagtatttacagcagtcgttgtactagggataacttacatctttgcctcttatcaaggatatccgatcattttgatcattctcggtttgatcgtcgcagcatatgggtttttgacaaataaaacagtagcaggtcgccagatttatgcgacgggcggaaatcgaaaagcggctgaattatcagggataaaaacaaagcggatcacgttctgggttttcgtcaacatgggagtcatggcagctttagctggattagttttagctgctcggttaaatgcggcgacacctcaagcgggtacttcgatggaactagatgtgatggcggcagtatattttggcggtgcttcaacatccggcggcatcggaacgattatgggtgcgattgtcggtggcttggtcatgggtgtattgaacaatggtatgtcgattttaggcgtcggggtagattggcagcaggcaatcaaagggttgatcttgcttttagccgttgtattagacttgtataacaagaaaaaacggacagcgtaggagaacaccgtttattcagaaaaaagactgtgacaagacatttgtcacagtctttttttcgctaaaagcgaacattcattgcttcgtttgtttagactaaaaataatgtatgtttttttaccattcgtataaattctctttttgctcttgattttttcgcttaattgagttaaattacatagggcgctaaaaaaagccttgattaaattaataatgttcgtgttttgctggatgtgaacatcaggaggataatgtaatgaaagtatttgattacgaagatattcaattaattcctaataaatgtatcgtaaatagccgttctgaatgtgatacaacggtcacattaggcaaacatacattcaaaatgccagtagtgcctgccaacatgcagacgattattgatgaaacgattgcagaattcttagcggaaaatggttatttctatatcatgcatcggtttgatgaagcagctcgaattccgtttatcaaaaaaatgaaaaagcgcggattgattacctcgatcagtgttggcgtcaagaaagaggaatattcctttatagagaagttggcagaagaatcgctaaatcctgattatatcactatcgacatcgcgcatggacatgctaactcagttattgatatgattcagcatattaaaaaatatttgcctgaaacttttgtgattgccggtaatgttggtacaccggaagccgtccgtgaattggaaaatgcgggcgcagatgcaacaaaagtcgggattggtccaggaaaagtatgtattacaaaaatcaagacaggctttggaactggaggctggcaactggccgctcttagatggtgtgcgaaagcagctcgcaagccgatcatcgctgacggtgggatcagaacacatggcgatattgcaaaatctgtccgttttggagcgacaatggttatgattggctcattgtttgccggtcacgaggaatctcctggcgaaacaaaagtcgaaaacggaattgtatataaagaatactttggttctgcttcagaattccaaaaaggtgaaaaacgaaatgttgaaggaaagaaaatctggatccaacataaaggatctttgaaagatacactagtggaaatgcaacaagaccttcaatcatctatttcgtatgctggaggaagagatctggaagccattcggaaagttgattatgtcatcgtgaaaaattcgatttttaacggagatacgatctaaataatgagcaaaatatcagcggaaggttcataacagaaccttccgttttttatgttttgcaaaaaaagcttttcttttttctcgtaaattcggtaaaatcaatagaaagaatggacaacagaaaagagaggactatgtgggaaaaggtagagaaaaaacaaggaccgatttatcgtcaaatcatggaacagatcatgagagaaatcgaaagtggaagaatcaatcctggagatcaacttgaatcggaacgaaaactagggcaattttttggtgtaaatcgttccaccgttgttcatgcattggaagaacttagagagcttggcgtattaacaagtaaacgtggtagcggttggttcgtcaatcagactgaatgggggaaattcgccgttccaagaatcgattggcgacaaatgatctcacctcgctatgaacagacggattggtatgagcaaaaaataaaagaagcaaagcagagccaaaaaacattgttccttgacttatatgcgagtgagatgccaaatgagcttttgccgaattttgagtttccttcttattctcttgaagaaatcttagcggaagaaaaagaaatggatcttttaggctatactccgttacgtaacaaaatcaaacggtatttggaaagtaaatttgaactgaccttttccctaaaccagcttctggtgactggtggtggccagcaagcaatctttttgatcttacaaacgattctttctgctggagaggggatagctgtagagtcaccttcttttttttaccgattacctcttttcaaagcttcaggaacgcgtttatttgggataccgatggatgaagaagggatcgacttagaaaaactgaaagaatcgatccataaaaataaattgaaagcagtgcttatcaaccccaattttcaaaaccctacagggaaagtgatgagccaaaagcgacgagaaaagctagtagaattgtgtcggcagtatcggcttccgattattgaagacgatgtatttacggacctttcatttctaaagcaagatgaagttcttcctatacggacgattgatccggataatgtattatatgtcggttcgttatctaggattttaggaaaaacaacgaaaatcggttggttgatcggaccagagacctttatcttgcaactcgctaaagcgcaagaaatgatggagtttccgatgaacatccttacacaaatcacggccgctaatgtatttgatgaagcaattgatttgaaaatgttggatgtaagaaaaaaattgaaagaaaaaagccaactgataagtatttgggcggagtctcaatcgtttttcaagcttcattcgattctaggtggttattatgcttggatcacttgggatggaaaaaagctggacccccaactagcagaaaaagtagtagatatgggtctaggaatcgcaccaagtctactttttgggcaagatataaatggaatcagaatcaattacagtcgtctagatgaagccaacatatcgttgttttattcaaagatgaaaattttagaacagtggttaacagaataatttcacaaagtaaaaagattaaagaatataacagctgggatttaaatttccggctgtttcttttttttcttaaaaagaagacgagacaaagtattagggaaaaaaacactttttgtacaaccgttcacgatgtcttaagaaaataaatagttgcagcaaaactgtataacaccagcgtttctaaatagaaacagatcattataagtttgattagaaaatagaaaaaacacagtctaaatataaaacgctttccttattgtgattatattcactaatgctgttaatatgcggattggcataatttcctttcatcgtgaaaatttgtgcttttagcttgtatttctcataaatccatgataatttattaatgaagacggttaaatagtgatacagttttattcgctgtttcaatcgcagaatgaagagattttcttatagatgagagaggaatgtgtgacaaatggcaaacaaaaaagcaccgatcgacttccaagcactgctagatgaagtcaatgcagatttcccagtatatcaagcacttgatcaagatggaaacgtagttaacaaagatttagtacctgatttatccgatgatgaactcgttgaattaatgactcacatggtatggtctcgtgtattagaccaacgttccacagcgctgaaccgccaaggacgcctaggcttttttgcaccaactgccggacaagaggcaagtcagctggccagtgcgtatgcatttgataaagaagatgttcttcttccaggttatcgagatgtccctcaattagtaaaacacggcttacctttatcacaagcatttttatggtctagaggacatgctgcaggtaattcttatccggaagaattgaaagctctaccaccacaaatcatcatcggtgcacaatatgtacaagcagccggtgttgcattaggtttgaaaaaacgcaacaagaaaaatgttgtcttcacttatactggtgatggcggttcatcacaaggtgatttttacgaagcaatcaatttcgctggtgcttaccatgcaaatgctgtattttatatccaaaacaatgggtatgcgatctctacacctcgtgaaaaacaaaccgcagcaaaaacacttgcacaaaaagctgtcgcagctgggattccaggaattcaagtcgatggaatggatccgcttgcagtatatactgtatctaaaatggcacgggaatgggcaatcagcggaaatggaccagtcctaattgaaacactgacttatcgttacggaccacatacactatctggggacgatccaacccgctaccgtacaaaagacacagatgacgaatggcagaaaaaagatccattgatccgcttccgtaaatatctgacggaaaaaggactttggtctgaagaaaaagaagaacaagtgattgaagcaactaaagaagaaatcaaagcagctatcgcagaagccgacaaagttccaaaacaaaaggtttcagatttcttgaaaaacatgttcgaagtatctccacaatcaatcaaagaacaaattgcaatttatgaagcgaaggagtcgaaataatcatggcacaaaaaacaatgatccaagcaatcaccgatgccttagcacttgaactagaaaatgacgagaatgtcgttgtttttggtgaagatgttgggaaaaacggaggagttttccgggcaactgaaggattgcaggaaaaattcggagaagaccgagtattcgatactcctttagctgaatctggaatcgcagggttgagtttcggacttgcgttggaaggatttcgtccagttcctgaaatccaattttttggttttattttcgaagcaatggatgaagtagtagctcaaatggctcgtacaagataccgaatgagcggtactagaaatctaccaatcacgattcgttcaccatttggtggcggtgttcatacaccagaactgcattcagataatttagaaggtttgattgcccagtctcctggtattcgagtagtgatcccatcaaatccttacgatgcaaaaggactattgatttcttctattagaagtaacgatccagttgttttcctagaacacatgaaactatatcgctcattccgagaagaagtgccggatgaagcttacgaagttcctttggacaaagcagcagttactcgtgaaggaacagatgtatctgttatcacatacggggcaatggtgcgtgaagccatcaaagcagcagacaatcttgcaaaagaaaatatctctgttgaaatcattgatcttcgtacagttgcgccattagatgtagaaacgatcattcaatccgtggaaaaaacaggtcgcgtagtcgttgtccaagaagcgcaacgacaagcgggtgttgctgcgcaagtagtttctgagatctcagaacgcgctatcctttcattagaagccccaatcggacgagtttctgcacctgatacagtcttcccgtttggacaagcagaaaatgtttggttaccaaacgcaaaagatatcgaagacaaagtaaaagaaatcgcggaattttaagaaaagaagggacgaaacaaagtcatggcttatcaatttaaattgccggatatcggtgaaggaattgcagaaggtgaaatcgtcaaatggttcgtcaaaccaggagatacgattaatgaagatgatacattattagaagttcaaaacgacaaatcagtagaagaaatcccctcacctgtaacaggaacggttaaaaatgtcattgttccagaaggtacagtagcaaatgttggggatgtattggtagaaatcgatgcaccaggacacgaagacaatgaaggggacagtggtgtagccgcagaatcccaaactccagctaacccggctgctgaaccaactgttgatacagaatcagctggatcgtcaagcgaaggagtcttccaattcaagttaccggatatcggtgaaggaattgcagaaggtgaaatcgtcaaatggttcgtcaaaccaggagatacaatcaatgaagatgatacattattagaagttcaaaacgacaaatcagtagaagaaatcccgtcacccgtaaccgggacagttaaaaacgtgattgtcccagaaggaacaatagcaaatgttggggacgtgttagtagaaatcgatgctcctggacacaatggtgcaccatcaactagtgcgccatcagctgaagcaccaaaagaaaaagtagaaacatcaggttcagcaagtgtcgttgaagctgccgatccaaataaacgtgtattggctatgccatctgttcgtcaatttgcccgcgaaaaagatgtagatatctcacaagtaactgcaactggaaaaggtggcagagtaacaaaagaggacatcgaaaacttcttgtcaggtggtccaagcagtgcaccagcgaaatcagaagcgccagaagcggcagcgccgaaagaagcagctcctgcagcagaaagcaaaccatctgcaccagcaaaaccattcaagtccaacttaggagacttggaagaacgtgtagcaatgacaccaacacgtaaagctattgctaaagcaatggtcaacagtaagcatacagctccacacgtgacattgcatgatgaagtagaagtgtctaaactatgggataatcggaaacgatttaaagaagttgctgctgcaaatggtacgaaacttactttcttgccatatgtcgtgaaagctttaacagcgactgttaagaaatacccagtattgaatgcatctatcgacgatgcaaaccaagaaatcgtttataaacattactacaatatcggtattgcaactgatacggatcacggactatatgtaccaaatgtgaaagatgcagaccgcaaaggaatgtttgctattgcagacgaaatcaatgagaaagcaaaattagctcatgacggcaaactatctgcagaagatatgcgcaatggaacgattacgatcagcaatatcggatctgtaggtggcggttggtttacaccagtcatcaactatccagaagtagctattttaggtgtaggaacgattgcacaacaaccaatcgtaaatgctgaaggcgaaatcgttgtcggtcgtgtgatgaaactgtcattaagtttcgatcaccgtatcgtagatggagcaactgcgcaacaagcaatgaataatatcaaacgtcttttagctgatccagagctattaatgatggaaggatgataaacaaatggtagttggagattttgctgtagaattagatacagttgtaatcggtgcgggacctggtggctatgtagctgccatccgcgctgctgaaatgggacaaaaagtagcaatcattgaaagagagtatattggcggtgtttgtttgaatgtcggctgtattccttcaaaagcactgatagctgcaggacaccattatcaagagtcactagattctgaaatgtttggagtaactagtgaaaatgtcaaactagattttgcgaaaacacaagaatggaaagaaaacaaagttgtccatacgttgacttctggtgttggtttcctattaaaaaaacataaggttgaaacaatcgaaggagaagcgttcttcgtagatgatcacacactacgcgtcatccatccagattcagctcaaacttattcgttcaataacgcaatcatcgcaacaggttcccgtccaatcgagattccaggatttaaattcggaggacgtgtgttagattctactggcggattagcattgaaagaagtacctaagaaatttgtgatcatcggtggcggtgtgattggtgccgaattgggcggagcgtacgcaaacttaggagcagaagtaacgatccttgaaggttcaccacaaattttaccaacttacgaaaaagatctagtaaaattagtagaagatgatttcaagaaaaaaggtgtaacagtcgtaacgaatgcaatggcgaaagaagcagtcgataacggtgacagcgtgacagtgaaatatgcagtggacgggaaagaagaatccgttactgctgattatgtgatggtcactgtaggtcgtcgtccgaatacggatgatatgggcttagaacaagcaggagtcgaagtaggagaacgaggattgattacggtagataaacaaggacgtacgaacgtacctaatatctatgccatcggtgatatcgttccaggggcggcattagcacacaaagccagttatgaagcaaaaatcgctgctgaagcaatctctggcaaaaaagtagctgtagattataaagcaatgccggcagtagccttcactgaccctgaattggcttctgtaggtatgacgatcaaagaagcaaaagatgctggtatcgaagcaaaagcatacaaattcccattttcagggaacggtcgggcattatcgcttggtaaaacagaaggattcatccgtctagttacgacgatcgaagataacgtgctgattggtgcacaaatcgggggagtcggtgcaagcgatatggtttctgaattagctttagcaatcgaatcaggaatgaacgctgaagatatcgccttgacgattcatccgcatccatctcttggcgaaatcgtcatggatgcttcggaattagcattaggcttgccaatccatatttgatttgaataatacaggcgaaacgcaactgagaaatcggttgcgttttttcttttttattatcaataatttaattatgtaaacttaataatacgacaacttcttggtttattaccgtctcctatgctacactaaagaagaatatgaaataggagagttgaagatgcaagaatatcagtatccacttgatttagactggacaacagatgaaatggtcattgtaatgaagatgtgggaagatctggaacgtgcgaatgaaaaagggataaacaatgaagcttttttgaagacctatcagcagttcaaaacagttgtcaaatccatcggagaagaaaaacggttgggacgggaatttgaaaaagcttccgggtactccttatatcgaacagtgcagcaagcaaaaaaaaatccaaacaaaactttgagaatgaacgggtgagataaatggaacagatgattgatcatatcaaatcctggctagaagaagctggtgagaaaatcaaatcttctcaacaaacattaacgatctcgcaaaaatcaaatcgaacggatctagtgacaaatgtcgaccgaaacatccagaattttctaatcgaaaaaatccattcctatgatccagaggcgaaaatattggcagaagaagaagggtgtaataaactatcggatctcgatggaagagtctttatcatcgatcctattgatggcacattgaatttcgtgattgaaggggaaaacttttgtatcatgctcgctgtttatgaatccggcgttggaaaacttggtttcatttatgacgtcatgagaaatgagcttttttggggtggaaaaggaataggtgtctataaaaatgacaaaccaatgcctagaccagcaaataaatctttatcagaaggcttacttggtgtgaatagctatcttttcggtcataataaatatggaatccgagagattgcggaaagcagcatgggaacacgtatgtacgggtgtgcagggcttgaactagccgcaatcttgaaaggaaaccatattgcttacatttcgaacctcagcccttgggattatgcagcgggaaatgttttattggaagagtttggtatggtaacaagcggtctttttggcactccattgacctttgatagaagggaatactatttagcagggactccttgtgcatatgcagaaatcgcagaccttttgaaaaaagaaggctgaaaaaaggtagaaatcattcacaaaaatgataaaaacgggcaaaagattaattttctcgaaaaaatgaaaacattttactatatttcatgaaaaaagtctgctataattagcagtcgagtaaaatttgccctgtcataaagaaccaataaaaaaggagttagttacattgaattatagaaatgatatccgtaacgtcgcaattattgcccacgttgaccacggaaaaacaacattagttgatgaactattaaaacaatcagatacattagacgcacatacgcaattgcaagaacgtgcgatggactcaaatgcgctagaaaaagaacgtggtatcacgattttagccaaaaacacagctgtagactataaaggaattcgcgtaaacatcatggatactccaggacacgcggactttggtggcgaagtagaacggatcatgaaaatggttgacggcgttgtgttggtcgtagatgcgtatgaaggaacaatgcctcaaacacgttttgtattgaaaaaagcattggaacaacatatcacaccaatcgttgtcgtaaacaagattgacaaaccttctgctcgtcctgagcatgttgtagatgaagttcttgaactattcatcgaattgggagcagatgatgatcagttagactttcctgtgatttatgcgtctgcactgaatggtacgtcaagcttatcagacgacccagcagatcaagaaccaacaatggcacctatttttgacacgattattgaaaaaattcctgctcctgtcgataatagcgacgaaccattacaattccaagtttcattacttgactacaacgattatgtaggtcgtatcggaatcggacgtgtatttagaggaacaatcaaagtaggcgaccaagtagcattaattaaattagacggaacagttaagaaattccgtgtaacgaaattatttggtttctttggactaaaacgtctagagattcaagaagcaaaagctggagacttgattgctgtctcaggtatggaagacatctttgtcggtgaaacagttactcctgtggatcatcaagatgcgttacctatccttcacattgacgaaccaacattgcaaatgactttcttagttaataattcaccatttgccggtcgagaagggaaatacgtaactgctcgtaaaattgaagaacgtttgatggcagaacttcaaacagatgtatctttgcgagttgaaccaacaaactctccagatgcttggactgtttctggtcgtggagaattgcatttgtctatcttgattgaaaacatgcgtcgtgaaggatacgaattgcaagtatctcgtccagaagttattgaaaaagaaatcgacggtgtaaaatgcgaaccgtttgaacgcgtacaaatcgacacaccagaagaatacatgggtagtgtcatcgaatccttgagcttacgtaaaggtgaaatgcaagatatggtccatacaggaaacggacaaatccgtttgacattcttgacacctgctcgcggtttgatcggttattcaactgaattcctttcaatgacacgcggttacggaatcatgaaccatacttttgatcaatacttgccaatgcttcctggtcaaatcggtggacgtcaccaaggtgcgcttgtttcgatcgataccggaaaagcaacgacctattctatcatgagtatcgaagaacgcggtacagtcttcgtagaaccaggtacagaagtatatgaaggaatgattatcggagaaaacagccgtgataatgatttgactgtcaacatcacaaaagcaaaacaaatgacaaacgtacggtctgctactaaagaccaaacatctgtcatcaaaaaaccaaaacaattgacgttggaagaatctttggaattcttgaatgatgatgaatattgcgaagtaacaccagaaagcattcgcttgagaaaacaaattttagagaaaaatgctcgtgaaaaagcatctaaaaagaaaaaataatctgtaaaaggatgaagagagaaaccagcttgttataaaaaatagctggtttcttttttgtccaacttatttctgtggagaagtcatctttgtcaatggacttaaattcagaaaatacgccaaaagacatttaaaagacttttaaagaacttgattctggtgtgattttgtttcatatcgcgcgtatgtttcacaagagggatcaacttgtccttcggagaaaaccgaagtaaaatggcaagggaaaggagcgggaagatgaacgacttattaaaacaatactttggttatgatgagtttagacctggtcaaaaagaaattattcagaaagtcattgatcaggaaaatgtattagggatcatgcctaccggcagtgggaaatcaatctgttaccagcttccatctttactagtagatgggcttactgtggttgtatcccctttgatctctttgatgaaggatcaggtggatgcagcgaatcaattaggtatacccgccacttttatcaatagctcgttagatggttacgaaacagctagacgcttccaagaaatcgataggcagcagtatcgtttactttatattgctccagaacgttttatcatgtcggatttcattcaagcgatgaatcgatggaacgtctgtatgattgccattgacgaggcgcattgtatctctcagtgggggcatgatttccgtccaagttatttacaaatggcgaaacagctagatcaactgccaaatcgacctgttattgttgcactgacagctacagcaactatacaagtagccgctgacataaaaagacttttaaaaatccctgacggcaatcacatccagactggttttggacgggaaaatctccgctttcaagtagtgaaagaccaaaaaaaagaacaatatctagtcgagtatttgaaaatcaacaaaaatcaatcgggcattatttatgcagcgacgagaaaagaagtagaccgaatctatcatttgcttaaaaaatttggattttctataggcagatatcatggtggcctaaaggagaatgaacgaacggcaatgcaagaggcctttttatacgatcgcttacagctaatcgtagcgaccaatgcattcggcatgggcataaataaaagcaatgtccgttttgttatccattatcaaattcctggctctctagaagcatactatcaggaagctggtcgtgcgggaagagatggtctttccagtgaagccatcctgcttttcgctcctcaagatattcaggtccaaaagttttttatccatcagtcccaaagagaagaggagcaaaagcaaaaagaatatgaaaaattaaaagcgatgacagaatatgcgtatatagaatcctgtcttcagcaatacatcctaaactattttggcgagacaagcagtccgtgcaatcgttgtggtaactgtttagatgacagagaaatagtagaagtaacgacacaagcacagatggtcctttcttgtttgaaacgtatgggggagaattatggcaagcagatgctaatgaaagtcttggcaggatcgaaagaacaaaagctgcgagccttggggtttgaacgtttatctacctatggactgatgaaaaaccaatcgcaaaaagaaacgatgcaattgattgaatatttgatatcgaatggctatcttctgaccgttaatggagaatatcctatcttgaaagtaacagaaagagggatccaagtattaaaaggacaagaagctgtctatcgaaaggaacccaaaaaagtccagcagctgtcggatgaagagaccgatacactatttgaagtgttgcgggaacttcgaacggatctagcatcagaagcaggcgttcccccgtatgtcgtattttcagattccaccttgaaagaaatgagccgaatacgtccatcaagcagactggagatgcttcagataaagggagttggtcaaagcaagcttgataaatacggagaagcctttttatctcggataaaaaatacggatcctaacgttctggacaagtaagaaggaccattacgtaaaaatgaataaaaacaactggttaaatctgtttttttgctccctatgaaaatcaaatatgttataattaaggaattagaacgggaggtaagcacagatggattctttgtcgaaaaaacttgcgatccaagtattaaatgatgaagcagaacggatcaaacgattaatccgaaaccaaaataacagtctctgtatctcgcaatgcaaagccttcgaagaagtggtagatacacagatgtacggtttctcccagcaagtcgggtttgctgttcgtataggagtaatcgaaaaaaacgagggacagctgatgttaagtgagctggaacgagaattgaatcagttatacagtgaggtttaccaagaaaattatgataaaaaagaagttggcaaggaggaatagacttgcctaagaaagtaaaaaaaaggcatctattagactatagtatcttgattccctatttgattttatgtgttttgggtttgatcatggtatatagttctacgtcgtatctattattagaaaacggacaaaatccgtccgcatcagtcattaaccaaagtattttttgggtgctcagcttgattgctatcgcactactctacaaaatgaaaacagatgttttgaaaaaccagcgtttgattatggcagccatcgcagttttgacgattttgctgctgatcgttgtgtttttcggtaaagaaatcaatggtgcaaaaggttggcttcaaattgcaggattttcgatccaacctgccgaatacctaaagatcatttctatctggtatctgtctctgactttatcaaaaaggcaaaacagtgtacaaaaagatttcctagggactgtaaaacgtccacttgcaatggttatcggactgactgctttgatcgctatccttcccgattttgggaatgcggcagttatctttttgattattttggttctgcttttagccagcggagttaattatgtgtatactttgattgtaggagtagggggtttttgtttaagtacttttacgatctggctaatcaatattacaaacggaaaaatcttgcctggacgtttacagtatatctataatcgctttgctatttaccaaaatcctttctcggatgaattaaataaaggccatcaattagttaatggttactatgccatgttcaatggcgggttatttggcagaggattaggtaacagtatccagaaaaagggatttttacaagaagcacaaaccgattttatctatgcgatcgtagtggaagagctcggagtgattatggggattttgatattagcgttgctattctttatgattgtgcgcattattcttgtagggattcgttcaagagatccgttcaattcgcttttgtgcattgggatcggcgcaatgtttttgatccaagtgtttgtcaatctgggaggaatcactggtgtcattcctttgacagggatcacgttcccattcttaagtcaaggaggatccagtttgctgatgctttcgatctgtgtcggctttgtcctcaacattagtgcggatgaaaaacgcaagagcttaggtttataataaaaaaagatgtaggagtggttcgatgaaaaaagttttagttgctaacaggggtgaaatcgctgtacgtgtatttcgtgcttgtacagaattaggaattaaaactgttggaatctatgcagaagaagatgaatattccgtacaccgttttaaagcggatgaagcatatttagtaggacaagggaaaaaaccgattgatgcgtatctagatattgaagggatcatttctatcgcgaaagaatgcggggctgatgccattcatcctggttatggtcttttatcggaaaacttgaattttgcgcaacggtgcgaggaagagggcatcacttttgttggacccaaactgcatcatttggatatttttggagataaaatcaaagcaaaagctgcagccatcgaagcaggaattgcttcaattccaggcacagatggtccaatcgcttctgtagacgatgcattggaatttgctgaacgattcggttatccgattatgattaaggcagctctaggcggcggaggtcgcggaatgcgtgtggctcatgatgaaaagagtgcaagagaaggttacgaacgtgcaaaaagcgaagcaaaagctgcctttggtagcgatgaagtgtatgttgaaaaatacatcgccaaccctaagcatatcgaagtacagattcttggtgacacacatggaaacgtcatccatcttttcgaaagagactgttctgttcagcgccgccaccaaaaagtagtagaagtagcgccttgtgtctctatgaacgaacagcaacgtcaaaaaatttgtcaggcagctgtccaattgatgaaacatgttgggtatgtcaatgcgggtacggtagaatttcttgttgaaggagatgatttttactttatcgaagtcaatcctcgcgtccaagtggaacatacgatcacagaaatgattacagatattgatatcgtgacaacacaactattgattgcccaagggttagatttgcataaagaaatcggattgcctcagcaagaagaaatcaaattaaatgggtcagctattcaatgccgaattactacggaagacccgttgaataactttttaccagacacaggaaaaatcgatacgtatcgttcacctggcggatttggcgtacgtctggatgtagggaatgcttacgctggctatgtggtgacgccgtattttgattcattgttagtaaaagtatgtacgcatggcgctacttttgaaacagccattcagaaaatggaacgttgcttgaaagaattcaggatccgtggagtaaaaacaaatattccatttatgctaaatgtcatcacacatcctgaattccaatcaggaaatgcaaaaacaacttttatcgatagtacagcaacattatttgaatttcctcgactacgagaccgcggaaataaaacgatgaaatatatcggtgaaattactgtcaatggttttccaggtatcgaaagtggcgaaaaaccattttatgaagaaccacgtatacctaaagatctaatcacaagaactgattacgtaacggctaagaacgtattagatgcgaagggtgccgatgctttggttgaatggatcaaaggacaggaaaatttattgttgacggatacgacatttagagacgctcatcaaagtctgctagcaactcgtgttcggacaaaggatttcaagcagattgcacgcttaacgggagaaggtcttcctgaactcttttcaagtgagatgtgggggggagcaacatttgatgtggcttaccgatttttgaatgaagatccttggcaacgattgagaaaaatccgttctttaatgcctaatacattgctgcaaatgcttttcagaggttcaaatgccgttgggtattctaattatcctgacaatgtactggtggaatttgtcaaagaagcagcagcacaagggattgatgttttccgaatctttgatagtttgaactggactcctcaaatggaaaaaagtatccaagcagtacgggatactggtaaaatcgcagaggcagctatctgctatactggcgatatcaacgatccaagccgagcaaaatacaatgttcagtattataaagacatggcaaaagaactagaacaactgggtgcgcatatcattgcaatcaaagatatggctgggttgcttaaaccgcaagcagcttatcgcttgattagtgaattgaaagaaacgacggatctaccaatccatctgcatactcatgatactagtggaaacgggattatcacttattccgctgcttcaaaagcaggagtagatatcgttgacgtagcaatgagtgcaatgagtgggaacacgagtcagcctagcatgagcagcttgtattatgcgctggtcaatggcccacggctgccagaaatcacaattgaaaatgcacagaaattaaaccattattgggaagatgtgcgtatgtattacaaaccatttgaaaatggcttgaatgctcctgaaacagaagtgtatatgcatgagatgccgggaggacagtattcaaatctgcaacagcaggcaaaagctgtcggactaggtcatcgctgggatgaaatcaaacaaatgtaccatactgtcaatttgatgtttggcgatatcgtgaaagtaactccatcatctaaagtcgtaggagatatggcactattcatggtccaaaatgatctcacagaacaagacatctatggaaaaggcgaaacactaagtttccctgaatctgtagtgactttcttccaaggagaactaggacaaccagtcggcggatttcctgaaaaactgcaaaagatcattcttaagggcagacccgcgttgagtaaacgtccaggactgttggcgaaatcagtcgatttcaacgaagtgaaaaaagaattggcagaaaaaatcggctatgaaccaaaacaagacgaagtattaagttatttgatgtatccgcaagtctttttggactatcaaaaagcgtataatcaatttggcgatgttacattactggatacaccaacattcttccaagggatacgtttaggtgaaacgatcaatgtacaaatcgaacgtggaaaaacgcttatcattcgtttagatgaaatcggagaacccgatatcgaaggaaatcgcgtactgttcttcaatctgaatgggcaaagacgggaaatcactatcaaagataattcaatcatcagtgcggttcaaactcgattgaaagctgaaccaacaaaccgagaacaaatcggagcaacgatgtctggttctgtgcttgatgtattagtgaaaaaaggcgataacgtcaaaaaaggcgacacgttgatgattactgaagcaatgaaaatggaaacagccatcgaagcacgttttgacggagaagttgcacatgtatatgtatcttcaggcgacacgatttcgtctggcgaccttttgattgaagtgactgaaaaataataagtgaaaggtggggaaacatgaaaagactgggtttgttttggctgattctgctattagttattgcggcattctatatggaaccagtcttgttcccgccaaaacttgaagtgaaggaaaactctgatcaacaaatctcaaatcaaatgacaacgtggaaataccaggagcttaaagcaactggtttttctacttatattggaaaaccgatcgaacagctagaaaaagattttggacaatcctatgatcgattaactagtgggtttggttttgaaacaagatattatgaaaacaaagccagtcatctcacgtttgaagtaaatgtccaagatagcatggtcacaactgttaaagtactgcaaacaggacctgctgatatcacgccgttttatttagggatgacgatgcaggacctaacgaaactcacgactatctatactaatttcacttttgagtatcacgacacagaagttggaatcgaactgatggaagaggatatgaattatcgtccactgattgcttttgataacgacacttttgctattttgttttttgatcaaacaacaaacggtctgttttcagttgtatatttagataaagatagtcttttgaaacttttaccgtatcaagtgtttggtgaaggtctcccacattatgaagcagataaatcggctgactgggaatcgatcaatcgcggtaaaaaacgaaaaagtacgactttactaaacatgcttagaagagaagacgaacttcctatatacaaccaaccgcttgcctttcaaagccacagtcggctgctgctacatgatttcttgacaaagcctgaagaaatcttgtcagacgaacgtatggctgattggcaaaaatcgctaggcagcgggcaaacgacaatgaaattctccttgacgaatgatgaattggagaagctaatcagtaaacagaaattagaaaatactagtggactgtttattcatccagcaatcgacgctactttttcgtttttatattggtacagcgatccatataatcatgaccgctttatggatccgggaacggattcattaggcattgctttttctaaagaaaatatgttagtcttattgcaagaagaaaacggagaaagtagtgatagcagtgatcgttaacgaagagctgtttcaactggaggatcaatgcctccgagtcgctgaaatgataaaaaagagtaaaacgatgacttcttatttcaaacataaacagtcaatgaaagaatctgcagaagtctgccaattaaaagaggcgttcctgtcgaagaaaaaggcgtttgaaaatgtagcggcatatggcgaatatgcacctgattatcgtgaaaaaaaacgtgctcttcgaaaagcaaaaagacagcttgacctgaatgagcatgtcgcagcttttaggtatagtgaaacacagttacaaagtctgttggatcaaattgtccaagcacttgccgaagaagtttctaatgagatcaaggtagatgcaggtagtccgttctttgaaacgaaaaaacactttggatgcggagggaattgtcatgcaagttgacaatagtgaatttgaaataataaaacgacgcgggctgatcgtatgggtctacagcttaaaacaattaaagaatctaaaaaagttcggcttgttgcattatgtctcaagaagaatgaaatatgtcgtcctttacttgaatgaagagacatttgaagagacagaagaacgaatccgtaaattacattttgttcgaaacgtagaacgttcttaccgaccagatatcgaaatgaattttgctgataaaataggtaataaaacggtattaaaagaagaaggtttcgaaatcgaagagctgaatacagaaatcagattagctgaacatctttaaaaatctcttatgagcagttttttaataaaaaaataacttggacaactatcaaaaattgatcattgtccaagtattttttggtcttttttttggtatactagtaccagtaccatttctaaggagtgagtagatgcggataatatcaggaaattatggcggacgccgcttaaaaagtttagcaggggcgaacaccagaccaactacagataaagtaaaagaatccatattcaatatgattggaccctattttgatggagagacagtattggatctgtttgcaggaagcggcggtctagctatcgaagccgtatccagaggttgcagtcatgcagtatgcgtagacaaaaattaccaagcgctaaaaatcatcaaagaaaatatcgagattacgaaagaaccagagaagtttaccacaataaaacttgatgcggacaaagcaatcgaacggctagcagcagagaaacaacaattcgattacttgtttcttgatccgccgtatgcaaaacaaaaaatcattgatcaaatccataaaatggaagaactgggacttttttctaaaaccgcagttatcgtatgcgaaacggataaaacagtcgaattgccagaatctgtggctggatttcatcaaataagaaaacagatttatggcataacagctgtgactatctatagaaaagagggaaatcgatgaaacgtgcattattcccaggaagttttgatccttttacaaaaggacacttagatacagtggagcgtgcggctaaattattcgatgaggtggtaattggtgtttttatcaatacttcaaagaaaagtttgtttcctccagaagaaagaatgacattgatcgcaaaagctgtggcacatcttcctaatgtaaaagtcatgcatcaggaaaatcaattgacagtggaaacggcaaaagaaatcggcgcggatgccttggtcagaggaatacggagtatcaaagacttcgaatatgaacgagaaatcgctcagatgaaccatcatctaaacgaggaattggaaacggtgttcttattggcaaaaccagaatatagccatgtcagttccagtattttaaaagaagtactgcactttggtggagacgtgagcagttatttaccgccagttatcaacgaagctttagctggaaagcgtgaatcaaatgaaagctaaacaatggttgaaaacagtactgattatcatatttggaatgttgatcatcggatttgtagtagttcctctgccatattatgtggaatcaccaggagcaacgattgatctgaaagaattaattacagtcaatgacaaagaagacaaaggttctggctctttctctcttacatccgtcggtatcaggcaagctaccggatttttggcgctaaaggctaaactagccccctttgaagaattaatcagtaaagaagaattgactggtggggcaacaaatgaagaatataatcaaatgcaacagtattatatggattcttcccaaaacgcagccatcgaacaagcgttgaaacttgcaggcaagccttataaaatggaattcaaaggcgtatatgtcatgagcgtagagaaaacatcgaacttctttggcaagctttcagtaggagatacagtaacaaaagtagacggcaaaagctttcaaagtacagaagcatttatggattatgtaaaaagccaaaaagttggacaaacaatcgaaatcagttatttgcataatggtgaagaaaaaacagcatctggtgatctgattgagttgccaacagataaaaaggcaggaataggcatcacacttactgatcatacagagatcgaatcagatacagacgttcgcattaattctggctctattggtggaccgtcagcgggattgatgttcactttagagatctatgaacaggtcactggtaaaaatttgcgacatggtaagcaaattgccggaactggaacgatcaacagcgaaggagaagtcggccgaatcggaggaatcgataaaaaagtggcaagcgcggataaagccggcgtagagattttctttgcaccagatgatacgatctcagacgatgttaagaaagaatatcctgaaataaaaaccaactacgaagaagcaaaagccgccgccaaaaaattgaattcctccatgaaaatcgtaccagtaaaaacagtacaagatgcgcttgactatctagagaaaatgaaatgaagcaactaaaaaaaagtgaaaaagctgctctgtatcaagtaataagaatagctacgcaaaaacagcttctcctcttttgtttggatttatttaccgcagatgcaagcttttgagctaattgaatactatttattttgaataagggattgtgacatattttctgtcacaatccttttttttcgtcaaaatatctttctgctaaaaaaaaagaaaaaattgacgtaattagatgttgaagggacgattttgccagagcacactgtttcttcgatttcaaatgaaaggagtaatgaatggtttttactgatcattctttgtaaaaagaaataatgatagaaaaaatcagcaagaaaatactcacctcacctaagttaatcgtttgtatgtctacggtagttcttattttttgtatagccagtggttttttattgtcaaatctgttatttcatagagaaccagaagaaatcgctgcaaaagaaatgctttctccatttagttccattgaagaaaatcaattgcctgaaggaaatactgtagaagaggatgctcgtccaaaggttatgtacaccgatataaaaggaagtgtgaaggagcctggtatctattcgttttcttcagaagaacgggtctatgatgtactaaagcgcgcaggaggattattagaagaagcggatagcgatcgaatcaacttttctgcgaaaatagaagatcagcaagtcctatatatccctgctgtaggtgaagagctgccagaacatcttgatcagttggcatcctcagaaggaaaacaatctacagcagattccgagccttcaaaaataaatatcaatacagccagtccctcagaactccagcagattcctgggatcggatcagtcaaggcgcaagaaatcattcgatttagagaagaaaacggatccttccagaaagtggaagacttgcaggagatctctggtatcggtgaaaagacagttgaaaaactaaaaaacttcgttacaattaaatagaatgattcagaatcaactgaaaagagcaataaatggaggctaatggatgacggacttcatttcggcagtgaaggatatgctcttttgtcagacatgatgattcggtatatttaaagaatattttgtttaagcaatggagtgcttttttgatcaacttgaaaaaacggaggaatgtaaaccatgttagaaaaatcttcaaaaccatgcgatacgaacaaagaaaaaattactgataagactcaaaacaaacgcattccctgggaccagtactttatggctcaggcagtattgttatctttacgcagcacatgtacacgtttagaagtaggagcgacacttgttagggaaaaacggatcattgctggcggctataatggagcagtcagtggagatgtccactgcatagatgaaggctgctatgttgtggatggacactgtttgcgaacgatccatgcagagatgaatgcgctgctacagtgcgcgaaactcggtatcccaacggaaggttcggaaatctatgtcacacattttccatgtttagcttgtacaaaagctttgctgcaagctggtgtcaaagggatcaattatctccatgactatcgaaatgatccgtatgctcaagcgttgattgaacaattaggcgtatctgtacaccaagttgctttagactcgcagcatttttcaaaacttcaaaatgaattaacaggaaaacatgtctagcgttttagaaaggcatgttcgaaatcggttgatttttccggcaattacgtcgatgattatttgtttgttgtatgatacggacaattggatttatcgtttgtttcttgccggaatttttttgtgattttcgctaaaagaaggacgttttatcgcgtacttctgtattgttggtagcataatggtatccgtttcttataagctacaagaatattcatttttagaggaaaaagaaacttctgcgcaagtgactttatctacagatacgattcgtgcaaatggcagttttttgacaatggaaggaaggttgtcagagagtaaacagaagatacagctttcttatcaagcaaacaccgaagaggaattgaaaacttggcttgggttccgaggggaggggatagaattgacagctgaaggcgagtttatttctcccgaaaaaaagcgaaatccttatacttttgaccaagaagcttacttcaggaaccatagaatctctggtcgattccaaattcaaagggtcgaaaaaatcaacatacaaaatcattggcgaaattggctccagagaaaaagaggcgcttttatttcttttgtccaatctgaatttccgcaaaaaacaagtgtatatatcaattctttattatggggttataaagattcaggcttcagagaatcagaagaaatttttagagagagtggtttgctgcatctattcagcctatcgggattacacatccaattttatttagggtggctgtattatttgtttcgacgtatcggatggccactgcacgtcagcatcattccgttgagtctgctaactatctgttatgtttctcttgcaggcagttctatttctgtcttgcgttctagtctgttgtttttattgcggttgctagtcaaattattgaataaacgttactcctctatggacttatttgcagttgtcttttggcttcttttgctatttgatcctcgatttctttttcatgcgggcggacagcttagttttttcatgagttttttgtttatcctgatttcttttgatggagattggatgaaaaaaacggcttctcatgtcctatttaccatgatcacgatgccgttgattgtatggcatttttatgagtggcctcttttaggcagtctttttacattactggttgcaccggtattcaagtttctttttcttcctagtgtgttctttctgacgcttttcaatcgctggttgccgagaaccttacttttgctgatagaagagggactgatcttgtttgaacgaatgatcgattcgttttcaggatcgactcttgttttatgtaggtctgttttctttgatgctattgactttgccatttttacgtttttcttcaacgatcgtttttatcgatgttggtcaaggagacagtatctttttgcaaagtccttttcgaaaagaaacgattttgattgatacgggtggtaagttgcactttgaaagggaaaagtgggcgcaaggtatcgtacgacctcctgctgaaaggaatatcgttccatatctaaaaggacagggaataagtgtgatcgataaactcatcttgacacacgatgatacggatcatgtgggagaattgtccacattatctcagcatttcaccatcaaaaaaatttatattggctggggtgctggacgaaatgagccgttgcgaaggcatttaacagaagctcaaaaaaatggcactaaaatcattgaagtcaaacatggcgacaggatcaaaggctattatgatctttatgtattgaccccttttgaaaagggagaaggaagaaatgaagattcaattggtttatggacggaatataacaatagccgttttttgtttttaggcgatttgaatcaagcgatggaagaacagctgctttttatttatcctaatttgaaagccgacgtagtcaaattaggtcaccacggtagccgcacatcaagtaatacggattttctttcccgtattgaagcgaaacatggaattatatcctgcggagtaaataatcgttatggtcaccctcacagcgaagtattggaggcactagaagaaaatcagataagaacatggcgaaccgatcagcaaggaatgatctcctatcgctggcatccagtttttcatcctcacggcctagtggaaacaatgatagactagtaattctcatcttctcatggtaggataattttgaaagtggtgagtaatttgagtatacaagcagagttacaaaaaatacgtaaagaaaaacttgcatcttgttacttgatcttaggaacagaaaagtttctccaagatcaagttcgggcagaaatagttaaaaaaatcaaattagagagcgaagatgatttaaattttttaagttttgacatggaaaatgcaagtttagaggaggtagtggctgaagcagagacattgccgtttttcggagatcaacgattagtatttgtggagaacccatattttttaacaggtgagaaagtaaacaatggaatcgaacaaaatactgatttactgacagcttatttgaaagaaccactagaatcgactgtattagtattttttgcaccatatgaaaagttggatgaacggaaaaaagtaacgaaacaattgaaaaaaacagcaaccatcatcaacgtccaacagctgaatgaaaaagaagtacgtcaatatctgatgaataccttagagaactcttccatcaaaatggaacgaaacgccattgatttattcttgcggttgaccgacttagatttatccaaaatgatgagagagttacagaaattaattctttatggacaaaatcaacagcagatcactgttcgagaagtagaacaattagttcctaaaacattggaacataatatttttgacatgacccaatatattttaaaagggaagacagaacaagccttgcgtttatatgaagatttagtcatgcaaggggaggaaacaatcaaaatcaatgcgattttactttctcaattacgtttgtttttacagacaaaatttcttgtaaagattggctatcagcaggccaatattgcagaaacattaaaagtccatccctaccgtgtaaaacttgccatgcaagaagtaaggaaattcgatgaacagttgctggtacaattatttgatcaattagtcgaaatggattatcaaatcaaaacggggcaaatcgaaaaagaattaagttttcaacttttcgttttgcgcacagggcagttgttgagaaatcgatagaaagaagaagccaaaagcatgcgggaataccggttgcttttggttttttttgacaaataaaaaaaccggccgaagccgattcttttacttagcgatttttttgcttaaacgagatttgtcgcggttagctttgtttttgtggattagaccttttgattcagccatatcaatagctttaacagcttctttatataacgcatctacgttgtcagcacctgaagctacagcatcttcaaattttttgattgcagtacgcatagcgcttgtttgagatgaatttttcacattagcgttttcgcttgtacgaacacgtttgattgcagattcaatgtttggcattagtttcacctccgataacttaagttcttacgcgtgtgaccgcataattcaacattcattattatacctaaaggcagcgcgctttgcaatatgaacatgacaagtttttttccttaacagtcttttatttaaacttttttatcagtaaaaacagataaatcaagctgaaaaaatcaaaaagacgctattgtgggaggcaatagcgtcaaaccaaactagatttttatttatctatttaaacaaagattgaatgggaatgtttggtactaagtcattatataacaaagagaaccgtttgcaaagttttttttgaaaagggatacgattccctgttgttctttattttttctattaagaaactgtagttattttataaccagtcacctttgatcggtaaaggttattctggtgtaccgattattttaatgtattcatcaatattttttatcaacatttttttaatgactaactgattccgacggttccatttgccacttacttccagtacatatttatttagtggcaaacgtaagatgtactttgccaaatagcgatctttaagcaggccattgatcacacggtcctcaagctgcaagttgattccagtcagcatcattggctgttcttgtaaaacatacgtatcaattaaaagaccttcaaaagtttccacaagcgtcttcctttctttccaaagtaacctgagaacaggtactgtttcttccattttgatattcgttaaagtggatgcaatcattccttcttttgtccactgtaatctagtataacaaaaaagaggagaagagccaaaaagaaaaaagagcatcgatttcaataggaagtctcattcgctcggtcattgtttaaaaaaagctcctgcatcgcaggagcatccctatatcattctaataggtcaatcaaaaagcagtatctaacacattttgtatcaaatcaggaaataaaagataagctaagcccagaatcaaaagtactgctaaaagaaaccagccaattgttcctatgaaatacttcaatttttcgaacattgtatcacctcgttgtcagtatatcacggatcagtaaattgggggtgttaagaatctcctaaaaataggcaaaatttgatctattttcctaaagcaaatacttgtaagatacagtaagtaatgccagaagcaatgactggtccggcggcgattcctcttaagaagacaacacctaaaatcgtgccaaaaacaagcgcaacagtgatttgcggatcagaagcaatcaatcctacgcccttggaagataagacagccactagcccaccgcaaaaaacagctacccagccgataggggatttaaaggcttctaataaatcacgtagaccgatttctcctgttgcgatagggatcagaatcgctgcagtgatgatcgtcacaccaatattgattcctttgccttgaagccaaggaaaaaaggaacgggaggctggtatgagcttcataatcagcacaaaagctgccgctatcattagactttgattcttagctaaaattgctacaagtaaaataatacctaaaaaaagccaactttccatgaaataattcctcactttcttcgaaacaatcataacatgtttttagaaagttgcaaaagcaggaatttatccttcgaaatctattcatacgctgattttttcataaaataaacaaaatcataaaaaaatttcacttatttggcagaagacagccgtgcttggtatagtggacaagacttacatttttttgaagaatcagaaagagcaggtaaaggtcttagcaagcgcaagccattcagaataaccaatatcgtgcttccttcgtgtcctactactccaagaggtagatttaaaaattgcaagaagttagaagcaatcaacaagagaataacaagaatcgaaaaaatgatattttgtttgatgatccgccgcatttttaaagatagccgatgactgtagacgaatttatctaagtcatttttcattaagacgatgtctgcgatatccattgcggcgtctgttccttgtcccatagcgatacctaatgaagcagctgctaaagcaggcgcatcattgactccatcaccaaccatcgcatttacttggtaacgttcattttcttttttgactagttgtgttttttcttccggagtacagctggcatagtaatgttcgattcctacttgttcagcaatagcctttgctgtgccagaatggtcgccagttatcatacttgtatggatgttttgggatttaaagtaggaaatcacctgttgggcatttgcttttggaatatccaacagacctaaaacagcgattaactgttgatctttagaaagatagattacagtttttccttgattttctaaacgttcgatcatttcctcaatctctttgctgattctcatcgtctcaggatcatatgcgtgtttgccaactttccattgcgcccctaaataggtagtttgtaatccaaaaccagtaatttcttctattgataggcattggattgcttcgggtattgtgcaatcgaaatattgtaaaatcgcatgagcaagagggtgtgtcgttttttgttccatagcaacaagaagttgttgtgccaaatccttctcatcaaagaaaaagctgtcagtcacaactggttttcctttagtgagtgttccagttttatcaaaggcaatcgcttttaattcagaaagcttctctaaatggatcccgcctttgattagaatcccattttttgcagaatttgaaagagcagctagagaagcaggagtagcagatgcgacaagcgcacaaggagaagccacgactaataataccattcctcgataaaagctttcatcccaactccaacctaagaaaaagtgggggagaaggatcattagaggcacagcaagcaaaatcaattttacataattgttttcgatccgttcgataaatgaagctgtttgagttggcgtattctgcgcttcttccactaattggataatcttagcaaagacagtttcggtactcgtttttgttactcgaattgtaatgggatttccttgattcagcgttcctgcaaacatctcatctcctaaatatttttctacaggtacagattcaccgcttaatgcagactcgtcgatcgttgcctgtgtgctttctaaacaaccgtcgatcggaacagccgctcctttagcgacgaacaccaagtcatccacctttaattgcgaaacatctacttcttgcatttgtccgttttcttttagtaactgagctttttgtggctgaagattcatcaaagcggtaatttctttttgacttttattggtcgtgtattcctctaatgcaccgcttaaacaaaagatgaatgtcaacattgctccctcaaaataattaccaatcaaacaggcaccgatagcggctaaagccatcaataagtccacattcagtgttcggtcattccacaattctttcaagccttccgatgtttgtttgtatccaccgatgataatagcgctgatataaaaaagcggggtgatggtgagagagaatcggtcgaaaataaaaccggcaatcataaataaaagacagccaattgttgctgcaaaagcttttttctgattagccatcgttatcagtcctccttgtcaaaacaaggatagcataataaaaatgtaattgataataaaaacagctaaatgagaacgataatggttatcatttgactatggagctcgatggagtttttattatttataataattatcattagataaaataaaaaaccggaacatttctcatacaagagaagtgttccggtttttcttacattgcaataaaccaataaccaattaaaatgataccaaggataatacgataccagccaaaagcggtaaagtcgtttttcttcaaataacttaataagaatttaatagctaagatagaaaccacaaaagatacgaatgttcctacaagaagaacaacagtttcttccattttgaatgagttcccttcagctaaatatttgacgatcttcaagccgcttgcgccaaacatgacaggaatccctaagaaaaatgagaattctgtagcgacaaaacgcgaagcgccaatcaagatagctcctaggatcgttgcaccagaacgagatgttccgggaacaagtgccaagacttggaataacccaacaagaagagctgcttggtacgtaaagtcattcagcgaagtccaacgaggtgttttgtttttgttacgtttttcgacaataataaaggcaataccgtaaacgatcaaaacaatggcaacgggtaagaacttgtggaaatttgcttctaaccaatcatccaaaggcaaaccaatgatgatggctggtatacaagcaacgatcactttaaaccaaagtgtccaagtatcttttttttctatcgttgatttacttggagaaaaggggtttaatttgtgaaaataaagaacgacgacagctaagatcgcccctaattggataacgacattgaacatcgacataaattgtgaactggcatccagtttgatgaattcatctgctaggatcagatgaccagtactactgatgggcagccattccgttattccttcaataataccgagaatcactgctttgataatatttgcaaaaaacataaattccttccttcccaattaagatacatcttatagtataccgttattttttgataaacccaatctgttttttaatattaagaaaaacttgagaaatgaagcagataagtatacgaagaaaaaaagaagacaaagccctcgttcagactttgccttttatgattctctgttaaaaattaaaatatcccatcataaaaacgagtctcgactatgtgctttcccgttttcgatataagacgtatcgttgataccatggatagaaaatcgaccgtttgcataagtaacctttgttacactgccatttaaaagaccagcacgaacaggctgtttaggatcgattagattaagcaagaaggcaatcgtcaaaccatgtgatacgactaaaacatttccgccgccgtttttttcgcagtgatgggcgatatcttcaaatcctgtccatacacgatctcgtaatgtttcataagtttctgcccatccagccgtatccaagttgtatacagcattggcaatttgttcaaaagaaacttctgtggtaaacatttcatcatatgttttaaaattcaatacgcgagggatcacaccccacatttccatgtcatagccaccttcaagagacccgaagcaccattctctgatccgtttctcgataaaataaggaatttcttttcccttagaatgttctcctagaataatacgggcagtttcgatcgcccgaccactgtcactagaataagcaaaagaaaagtcgacatcttttaacccgcgccctaaataatggatgccttcttgtccttgttttgtgagtggcgtatcacaccagccttgtacgcgttcgattgtattgaacatcgtttttccatgccgtacgatataaagtgtagtttctgtcattttattctcctcctaaatcatttttaacgattgaaaaaaggatttgtccttttttcctgttcgatcgttgttgcatcaccatgtcctggatagactgcaaattcatcaggtaaaacaaacagctgggtccgaatactgtgaagtaattgttctaaattccctgtatacagatcggttctaccgatacttcctctaaatagggcgtcgccagaaacgacaaaatcatcaaaaataaagctaacgcttccgatggagtgccctggagtagggaccacacgaaaagacatgtttcctaaagtataagttttcatttcaaattcatattctgcaggcgagacaataatatcagcaatatcatcatgtcgtccgagtccagaaaggttcaaaatcggatcacctagccatttttgctctagcgggctgacatacaccgagatttgataatatgcgcgtaaaggttctactgcaccaatatgatcatagtgggtatgggtaagtaaaatcgctaccggttgttggtttgtttttttgatttcttgtttgatttgttctgcatcttctccagggtcaatgatcaaaagtgcttcttcgttgtagaccaaataacagttttcttcaatcattcctgtttttaatctttcgatatgcatgtgcattcctccttgatagccaaaacttctttcatccattagtataacgcattcattgctaggaaacaaaaacaggtacttatttctctttacttatctgaattatcagactatatgaaaagtatttggatattctaaagagaaggaaagtaagttttcatagcattttaatatgtccttgttacattagactcatccaaaaatccaaattctatatcctatatccctgcctaatcagcagggtatttttttatgcttgaaaagagagctctttttgctaaactaggttttttcaggtaatcttagagagaaagaggtggtggaaatgatcaaacagtcaaaaatatctgtgcggcacttagtagaatttattttgcgacgtggaagtatcgacaatcgtaaaaaaagtagccatactgcattagaaggagcaagaatccaccgcaagctccaaaaagatgcgggagaagactatgaaaaagaagtctttttaaaaacaacagttccattagatgaatatcacctgatcgttgaaggccgtgcagacggtattttcaaaagagacggaatttattatatagatgaaatcaaaacctccgaaccacgatttgaagatttagaaccagagcaagtggaacttttctttcatcaagcaagggtgtatgcctatatctatagtcaagaacatgatttacaagaaataaatctgcaattgacttactttcagacggcagaagaagtgattacgagaaaggtcgaacatcagacaagagagcagttagaaactttttttaaaaaactgactgaagattataaagaatggcttgtttttcaagaaaactggcgcactgtacgcaatgcctctttgatggctttgaaattcccacatgatgagtataggaaaggccagcgtgaactagcggtagctgcttataaaacgatccgtacgaaacagaaattgtttgtagaagcacctaccggaacaggaaaaacaatctctacgttattccccgctttgaaagctgtaggggaagaagagggagaaaagatcttttatctaacagccaaaacaataactagacaagtagctgaagatgctatgacagcattaaaagatactggagctgaagtaaaaagtgtcactttgacggctaaagataagatctgctttttagatgagacgacctgtaatccagatcagtgcccgtatgccaatggttattacaatcgtatcaacgaagggttatgggatcttttgaatcatgagaatcagatcactcgagaagtcatcgaaacttatgcaagaaagcatacactttgtcctttcgaactatcattagatgtcagtatctggtgcgacgtgatcattggggattacaattatctgtttgatcccactgtttatttaagacgtttttttgaagatgaaaaaaacgaggattatctgtttttgattgatgaggcacataatttggtgaatcgttcccgagagatgtattcggcagaactatcttatgaaaaaacaaaacgaagtaaggaagctataccaaaggaattcaaaaaactccatcgtcgtttcaacaaactattgaaagaatttgatacgatccgagaaatagcaaaagaagatcattgggattatcatcatcaaaaagcaccagctgaatctttagtaaaggcaggttatcaattaagcgaaaaaatcaaagaatggctagcagaatttcctgagcatccatcacaagaacaattgcttccttattactttgatttgcttcattttttgaaggtcagtgaattttatgatgatcactatgaaacaacggtcgaaaaaacgtatcacgatctgatagtaaaagagttttgtattgatccaagcttgtttcttgagcagtcgttggataaaggaagaagcagtatccttttttctgcgagtttttcacccctatcttattatcaggaaacactgggcggacaaaaaagtctcgcttacaaactgccgagtcctttcccagaaggaaaccagcaagttttcatcgcaaattacttagagacgacttatcgaaacagggaacaaagtctggcaaaattagttgagacgatccatgcttttgctgatggaaaggtcggaaattatttcgttttctttccttcttatcaatatttagaccttgcggcggaagcattcaaacagcaatatcctgacagcaatgtgctgatccaagaaacggacatgaatgaagaagaacgcgaacgatttttagcaaaattccaagcagatcccgatgaaacattgataggattttgtgtacttggtgggattttttcagaaggaatcgatttgagagggaaccgattgatcggcagtatgatcgtaggtgtagggttgccgcagatgaatcatgagcaggaactgatcaaatcatattatgatgagaaggaacaccttggatttgcttacgcttatcagcttcctggaatgaacaaagtcttgcaagctggtggtcgagtgattcgtggcatggcggatcaaggaatcgtggtattggcagatcaacgatttgctcgtttctcttatcgacgtttattcccacaacattggcaaacagcaagagaagtacgaagtgttggagaattggaagaaggaatacagcgtttttggtcatccaaagaagcagtaaatgaaaaaaacgagggatgacagatgtcagcctcgtttttttcattaacgatagttagtgaattgcaactcgattggtaagtcaagtttacgtaataaagcaatcacagcttgaagatcatcacggtttttacctgtcactctaatctgatcttcttggatttgtgcttttactttcagtttttcatttttgatagctgtagtgatttttttcgcgttttcgcgatcgattccgttgaccagatcggcagtttgacgagctttgccacctagcgcgtgttccgattcggaaaaatggatatttttgattggcacatttcttttgatcaacttaccaaataatacatctttgatctgttcgattttgaaatcatcatcgctcaagacaactagattgctgttctctaatttgatttctaccgtagaatccttgaagtcaaatcgattagtcaattcttttgttgtttgctgaatcgcattttttacttcttctgtattgacttctgatacaatgtcgaagctagcatcttttgccataagaaccctcctgatatacgtataagtttactatacatctatcttatcataggaatggggcagattcttacttgtttgctaaaattcttctcatttgagttcgaagtattttattttaatagataaactgttattcttacatttggaataacaaagtagaggagaggtgcttgtgagcaaaattatgactgcgtatcataaaaatgaaagattaaagaaaatagtggttattttgataaccggattgaccgctgcggtcgctttaaattattttttgattccagccaatgtcttttctgcagggatgaatgggatcgctcaaatcatttcctcgcttttatatgaatggtttcatatcaaggtagacacaggaacatttatttttattttgaatatccctgtgtttgtattagggttcctcaaagtaggaaaacgagcaacgatccttagttttgtgaacgttgtatgcgtatcagtgatgacgatgctacttccagtcggacagatcactgataatattttgatgaatgccttagtaggcggtgttttattaggtcttggcgtagggttatctttaaaaatgggctttacaactggtgggatggacatcatctctcttgtgctttcacaaacaactggaaaaacagtcggaaattacatgctgattctaaatgggatcattgtagtcatcgcaggcttcttctttaactgggaaagtgccttgtatacgattatttccatttatgcaatgactcaagtgattgatgccatccatacgagtcatcaaaaagtaacagcgatgatcgtgaccgtcaaaccggaagaggtaacagaagaactagcgaaacggatggtacgtggaatgacattgcttccgtctgtcggtggctattcaaaaaaacaaggaaatatgatcatgatggtcatcacccgctatgaaatgtatgatcttgatcagatcgttcatgaaatcgacgacgatgcatttatcaatattttaccaactcattcagtatttggccgatttgcaaatgaaaacgaacaaaaaatgtatcgaacaacaggtgtattgccagaaataaaaaatcgttcacaaaaaaaatgaggaatcagatttattttagaatgaatttaatgtattccatctaacaaggacattttataaatttaaacgagaatcttccttctaaattctcatttacaagtagttaaaaaaagagtatgataaataaaaatcgtgttaaggagtgtcgtacgatgagcgaagcaaaccaagaacggtctgcgcaagaaatagaactgatcaaagaacgtattcttgctgccttggaaatggtgatcgatcctgaattaggaatcgatattgtcaacttaggcttgatttatgatatagaattcaatcctgaaaacggagaaacagtcatcaaaatgacgctaacaactatgggctgtccactagccgatattttaacagaatctatccatgacgcattgaaagaagtgccagaagtaacgaaagcagaagtaaaacttgtctggtatccagcatggacgaccgataagatgagccgttatgcacggattgcgttggggattcgataggaatcttgactgactagctatgagaagtaaatagtaaaaacaaaaaaccttttatccttttaagaagaaaagagataagaggttttttgtttataaaattttgtctgctatattagaagttaatcaaataaatgtgttctattgataaaggacgttcaaatccctttccttttgccatccatcttttttacatcaatttgattttcgtatagtattctttctcatcttcgcgataaatcgtggccccatttttttgctgcgccttaagactgcaaagattttttttatttacagacaaaagtgcctcatcgatgccgattttttttgcctcttgcagtactaatgctaaaccttgtgttgcatatccttttttacgatagtcaggggagatgccgtaaccgatatggccagcgccgtttcttaatgattcattcaatttatggcgcagattaaaaattcctacatactcatgtccatcattttccaaaataaagacggttgcgggaacgtaattctcaggaagatcgatccctaaagaagtgttttcgcatttttttacataatctaaaaattcagcaagtgtatagccgtaagcattgttgataaatccattctcgtttggtccgaagctagtttgcagacgataagctttctccaaatctgcttcccatagtttgatcaatttcatcgaatccgcctcttcctaagtaaacatatttttttctactatagcactattttggtgaatagccattcttatttttatttttttgtgatgtatcgtattaagaataatttaacaaaataaacaattgcagatttttgttatttattgtattgtttttataatagatgaatgctcgttatctttttaaaaaatgatcttattgattgatattgaaagttcaagataaattgaatttttaataaatgtgttatttaaagttttttcgtccgttgcttatgatcactagaaaggagatctcgtgaactactttagcggttataaaagaattccagaaggatggcaacaagcagaaataaaaaatgatcagtatcaaaatgaaagaagaagacaactgttggagaaaatgaagcaaaaacagctgaatcgagagaaaaaaaagaacaaagaaacgaagaaaaagcagcaaagtaaaatagctaccgatcccagagttgctcgtttaaacaatgaaatgaatcaattgaagcaagaattgagtaaagcaaaaaagcaagtagctactgtgagcaagaaaagaagagaggacaagaaacacatcagagagctgtcacagcaactcgaacgacagcaccagcaagcaaaagtagaaaaagaagagatgagacaaaaagtcatcgaacagcagaggaaaacagaacaattgtatcaaaaattagaagaagtgggctgggatacagataaccacgcacttcaggaactccaaaaacgtaaccagatcatcatttatttgctgcaaaaaaatagccaaatgcaacattatctagagagaatacataaagagtcagatttattaaagaaaagaaatgatcgactgaacaagaaattagaaaagctttcaaatagaaatgctacgtatctgaaaatcatggagaagaaaaaacaagaactgcagcagttgtctaaagtcaaccagcgacaaacagaacaattagcaaaggaaaaacaaaacttcgtacaagcagctcctcaagatctgatccatgcattgattcagcagttagacacccaatcattttataagttcaatcagctgaacaagctgttcaataggtatcaatggatctttgaacaacaagcaaatgatttgcagtatcaagaaacaaatatttttatggttttgtagaaatagaagagggtagcatttatttccacgaggtcaatacggagcaaagaagaccactgatagtagaagagagctttaaacgcaaagatcttttaacagatgggatagcagtacgagtacatcaaaaaacagtagacggtccagtatatctaaggtattgctatcctatcgttgaacagaataagttaaaaagaagaagcgacaaatatctaaagagaacaagtcaaaaatctaaacagccaagtaaaaagcaattgagcatagatgctgaaaagtgggcatcatcactcaaaattgctgcgatcgggaacaaacaaataaaaggattcgtaaaaggattgcagaaatatgtaaaaactgtcgaaagaatcgacgcatatgagtatggggagaaagcactatttgaaagaatccgtgctgttgactacgtctatgtttgcatcgatagcgtcccgcatcatgtgaccaattttctgaaaagtgaaattgagcttatggaaaaaacagaatttttttatcgcccttcaatagatgatggagttactcggatgaactatttgtattggttgcaagagggaaaacgcgtagagataaaaaagaacaaaaaatatgttcttgacaaaaaacaaatgtaatcctaaactagaacatgtgatgcggctatggcggaattggcagacgcgctagcttcaggcgctagtgagggcgacctcgtggaagttcgaatcttcttagccgcataatttttttatatactgagaaaagatatcgagggagagatcccatcggtatttttttataaaatctgatataaaatagatttcggtaagaaagtcatagaagtaatagataagcaaaaaactcgctctgatgtgacaaaacaactcaaaaagaggccatgcgatgtattctttcgcatggcctcttcctattttgaatgtgtttaaacgttcaaataatgaatcttagtaccaaccgtttgcttcccagaatgctttcgcagcttcccaagaaccataacgtgaagcaacatattgttctgccaatactttaccaagagtatcaatagttaatgtacccaacagcattcctctttttttactaatattatttaaattgtctaatataatactttgtacattattgcctatcattttttgttgagctacaattaaacgtttattagttaatgcgtatgcataattattgtcatgcttagttgatgagatataattatgcaatcctacaaagcagaagattacgtattcgtcactgttaagttgatctgatattaagttaaaatgatgagttgtccattttttagtcattcctttaccgtagccgtatttaagacaaaattctaccatctcttcagtggttctcattctatcattacctatatcatgattgttatgtgcagtatgatcagatatgtttaattttcttttttctgatggatccttatctaaatcttctaaattcaaagatcttattattttataaggagtagtcataccgtaaccagcttttttcatacaattgccgcaaacaatttgtttatctttgattttatatgaagttaagccaattttacctccgcactttgcacattgtttactcatattagttcctcctagatatcagctttctactactattaatattctatcaatagtgaccatactttgaccatactttttagaaagaatagaaaattacaagatatttaataatagaagaaaagcactaatatcatgggttcagaagcattgagagcttatcaggaaacagtataattgaagtgtctgtttatccagtagctcaagaagcttaattgaatcttgcgattaaagaggttgtgacaagacttttgtcacagcctcttctttgtttataaaaataaaagttgtaatgaaggatgcgaaggttaccatgtctttttacgcttaatatttttttgccatcttgtaatcagaatgttttgataacgattgtttttattaatgaaagcgatattgtttgctatcagcagcatcattgtaggataaatagtgttctttttcttgtttccaatataaaaatggaattgatattttgtgttcttttatcttcattacgcttgtcccttcgcttgttgtcaacaaaacaaaatcaggtaaatagttgacgaaacggaaataaatacatagtattatgttttgaagcctaagaacaacagtctatagaaaaggagcgataccattggcaaaacgcatggaccgaatttatatgtatgtcaaagaaaaaaccgctcatttaacaaaggcagaatatgaccaaggagtaacgacacaagaaattgctgaagtgttaggaatccaacgaacgaatagcagtaaggatctgaatcagctagtgcgcgaaggaaaactgataaagacagatggacgaccagtacgttacatatatcaaacactcgctacgcacgtaaagccagctgcaaaacatgtggtcagttacaaagaaacgccggtctctgaagaaaaaaatacgctccagatagatactaaggatatctttgcaaaaatcattggagctaatggtagcatgaaaaactcagtggaacaggcaaaagctgcgatcttgtatccgccaagaggattaaattgcttgattacaggacctaccggatcaggaaagacttattttgcgcacgcgatgtatcattttgccaaagcacatcatgtaatagatgaggaaacggaactgattgttttcaattgtgctgattacgcgaataaccctgagcttttgatgagccatttatttgggtatgcaaaaggagcctttacaggtgcagatgaagaaaaaatgggaattatcgatcaagcggatggtggtatgctatttctggatgaaattcaccgattgcctccagaaggccaagaaatgatcttttactttatggatcacgggacttacagtcgacttggagaaacaacgaaatctcatgaagcaaatgtacgaatcgtaggtgcgaccacagaagatccaggctcttcgctattggaaacttttgttcggcgtatcccaattaatatcaaacttccggcttttgaaaaacgtcctgcaaatgagaaagtcgatttagtaaaaattatgattgcccacgaagcgaaccgcacgcaacgaaagatctctttgacagaagatgtagcaaaagcactgattggcagtgtgacttatgggaatataggtcaattgaagtcgaatatccagttagtgtgcgcacgaggatttctaaatcatatgcaatctcccgaaatatcgattacgattgatgatttgacagaagggattcgtagcggattgattcaattagcaagcaaccgcagtgcaatggcagagctttctaaaatattggagccaaagataactgtagcaccaaacgatacgatcatgaaaatccaatcagactcctatgaattaccttataatctatatgatatcatcggagataaagcagctttgctgaagtcggatgggttggaccaagaagcaatcaatcactttatttctacagatatcaacatccatctgaagtctttttataaagaccatgggttttcttttaatgcagatagcaaattagcagaatttgtagatccaaaaatcatagaagtgaccaatcagatttatgtaatggtcaaaagatctttaccatatgactttcagcaaaactttatttatgctatgagcttgcatatcagttcgtttttgaaaaagatcaatttaggagaagaacggcatacgaatgataatatccgtgagatggcatttgattttccagatgaatatgctgttgcgaaagaagtgcgtagttatatagaaacgtattttcaagtggatattccagaaagtgaagactactacttgactgttctactcgtctcgttacgggcgaaccaagcaagcggcagaatcggtgtagtcgttgcggctcacggaaacagtacagcaagcagtatggttcaggttgtccaacagttgttagatgcagagaatgtacgagcagtagacatgccgttggatatggatccgaaaacagctttagaccgaattgaacgcaatgtacaagaagtagatgaaggaagcggggtcatactattagtggatatggggtccctcgcctcatttaattcgcaaattcagcgagacaccgggatacctgtacgtaccgttgacatggtaacaacttctctagttttggaaactgtgcgaaaggtctctgtattagggacagatttagatatgttgcatgaatcattgaagaattttcgaggttacgcagaaatatcttctgtagaacctgtccaggaaacaaaacctatccataagaaaaaagctgttttggccatttgtgcatctggcgaaggtacagcgcaaagaatcaaagaattgatcgaacgagcggtaaataagcgtcaagaaacagaattagaagttctagctttgtcgattgtggaagtgaaagaagaattgtcagttatccaaaaagaatatcagatcatagcaactactggaattactgatttgaatatccaagcaccatttattcctttagagcgcttcattgatcaaaatatcgaagtcattttggatcagttgcttatggaatcagaaatggaagaaactgaattcgtctcgctagatgaagagacagctaaaaaaacatgtgttgagtttatctctgagaacttcatctttatcaatggtagtaaactaatcgatccaatgtggcaattttctacacaagtctctcagacgatgggaattggcaatgaagaatatggttttaagatcaacttagtgatgcacacagcaggaatgatcgaacggattattcgaaatgaaacgttgacggtggaagaaaacgaattgacgaatacaatgagtgatcctctttataatcaattaacagcctcggttgtcctgctagaagataagataaaagtaaaagtgccaatagaagaagtgtattatctgctacgtctagtgcataatcagctagataaaaaagaatacactatgccttaaatacacaaaaacgatacactttcatagtgtatcgtttttgtgtattggttaagaatcctttaaattcaattagtgtatcacaaaaaaagttggcacgctttttgcttatagtagtgtgtgctaggaggtggttgttcacacagaaatgataggggtttctgtgaagtagtgaggaagaaggagttttgcagatggatattcgattggcacgtatagatgatcgtttaatccacgggcaagtcgcaacagtttggtcgaagcaaacaggtgttgaacgtatcattgtgatcagcgatgtagttgctcaagataaattgagaaagtttctattaaaagaagctgcaccgccgggaatcacagcaaatgtaataaccgtgcagaaaatgattcaaatctatcatagtggactattatcacgagcaaaagtgatgcttttattcaccaatccccaagatgttgaagcggttgtccgctgcggtgtacagttgaagtcgttgaatatcggcggtatgagttttactgaaggcaaatcaatgattaccaattttgtttcagtaaatcaacaagatattgattcctttcgttacttgaacagtcaagaagtggagttagagattcgaaaagtacctgctgacaggaaaatccttttgatggaactactagcgaaaatcaaaaaggtgtaacaaaaatggttgttggaaaaggtcaaataattctgttgtaatggttagcaattattaatatttttgaatttgttacaacaaaagtaaataggaggtataaatatggtagggattatcctagcaagtcatggacaatttgctgaaggaatcttacaatccggttcaatgatctttggcgaacaagaaaacgtcaaagccgtgattttgaaaccaagtgaaggtccagatgacttgagagccaaattggaagaagcggttgcttcttttgataatcaagacgaagtgttattcttagttgatttatggggcggaacaccgttcaatcaatcaaacacattattcgaagagcacaaagataaatgggcaatcgtcagcggtttgaatttgccaatgttgattgaagcctatgcatcacgcttttcaatggaatctgctcatgaaattgcagcgcatatcattgaaacagcaaaagatggtgtaaaagtgaaaccggaagaattagaaccggcagaagcaccgaaagcagcagtacaacaaacatcagctgcaggagctcctggtaaattcagttatgttttagctcgtattgattcacgtctgcttcatggacaagtagcgactgcgtggacaaaaacaacgaatccaacacgtattatcgttgtttctgatgcggtagcaaaagacgatcttcgtaagaagttgatccaacaagctgctcctccaggtgtaaaagcacatgttgttccaattgaaaaaatgatcgaacttgcgaaagatgatcaacattttggcggacaacgcgcgttactgttgtttgaaaatcctcaagatgttttaagagcagttgaggggggcgtaccgttggagacagtgaatgtcgggtcaatggcacattcacctggtaaagtacaaccaaataaagtgttggcgtttagtcaagctgatattgatactttcaataaattaaaagaagctggaatcaatttcgatgtacggaaagtaccaaatgattcaaaaggaaacatggacgaaattttgaagaaagcacaagatgaattaaacaaacacgcatagtaaaactatcagaaaaaatggaggattaacatcatggaattaaactttattcaagtgatattagtcattatcgttgcatttttagctggtatggaaggaattcttgatgaatttcatttccatcaaccagtaatcgcatgtacgttaattggcttagttactgggaacctaatcccttgtcttatcttaggtggtacattacaaatgatcgctcttggttgggcaaacatcggcgctgctgtggctcctgatgctgctttagcatctgttgcatctgcaattattttagtattaggtggacaaggaagagctggagtttcttcagctatcgctattgctgtccctcttgctgttgctggtttattattaacaatcatctgtcgtacgattgcaactgcattcgttcatttaatggatgctgctgcaaaagaaggtaactttagaaaagttgaattatggcacattattgctatctgcatgcaaggtattcgtattgctattcctgctggattgatcttagctatcggcgaaggtccagtgaaaggtttgctagaatctatgccagtctggttaacagacggtcttgctatcggtgggggtatggttgttgctgtaggttatgcaatggttattaacatgatggcaactaaagaagtatggccattctttgcaattggttttgttttagcaactgtttccgaaattacacttatcggactaggggcaatcggtgtagctttagctcttatctacttggcactttctaaacaaggtggcggttctggtaataatggtggaagctcaaatactggtgacccactaggcgatataatcgataactattaaaggaggcgtacacgaaaatggcagaagaaagaattcaattatctaaaaaagatcgtgtttctgtttggtggcgttcgactttccttcaaggatcttggaactacgaacgtatgcaaaatggtggctgggcattctctatgattccagcaatcaaaaaattatataaaacaaaagaagatcgtgcggctgcattggaacgtcacttagagttcttcaatacacatccatatgtagcatctccaattattggggttactctagcacttgaagaagaacgtgcaaatggtgcacctgttgatgacgtaacaattcaaggggttaaggttggtatgatgggacctttagctggtatcggtgacccagtattctggtttacagtaaaacctatccttggagcgttggctgcttctctagcgatgagtgggaacatcctaggacctatcatttacttcctaggttggaacatcatccgtatggcatttatgtggtatacacaagaatttggttataaagctggttctaaaattacagaagatttatctggtggattattacaagacatcacgaaaggtgcttcgattctagggatgtttattcttggatcgctagttaaccgatgggtatcaattaactttgctcctgttgtttcaacagtcaaacttgataaaggtgcctatatcgactggaataacctgccttctggtgcagaaggaattaaaactgcattggaacaacaagctgctggtttgtcactgtcatctgaaaaagtaactactttacaagataacttgaatagcttgattcctggtctagctgctctatgtttaacattgttctgtatgtggttacttaagaaaaaagtatcacctattgtcattatccttggattatttgtggttggtattgtcttccacttgattgggttaatgtaatcttgaaaatatatgtaagttaagtaatggttgaaactacttgtttctgaaaaaacggttactttggaaaactgtgccaattcctattggcacagtttttttatcagtacattagaagattctttgcttaaataggtaaaaacatctataattgattcactagttaatttaaagaatggagtagaataaatggtacaatcaatcaatacgaaagtcgatttaacgattaatgctacttcctatctgggaattgctgagtatggaaaaatcatgattggcgataaaggttttgaattttacaatgaaagagatgcccgaaaatttgttcagattccatgggaagaagtcgactatgtgattgcttccgttatgttcaaaggaaaatggattcctcgttttgctatccaaacaaaaagaaatgggacttattctttttcttctaaaaagcccaaaatggtgttaaaagcgatacgtgaatatgtagaacctagtcatatggttaaatcattaagcttagtcgatgttatcaaacgagggatcaaagggattttcaaacccaagtaaaaaataaaagttgaccaaaccaattatttgtcccctttaaatcccttatgctaaaattgattagcaaagaaggaggttatattatgagttggttatggacattgattgttggagctgtgatcggagcgattgcaggtgcaatcaccagcaaaggaaattcgatgggctgtatcacgaatatcattgctggattagttggttcaagtattggacaagcgattttcggcgaatggggaccaaaagctgcaggtatggcacttattccatctattttaggtgcagtgattttggtagcagttgtctcgtttttctttggaaaacggtcataagttttttacaaaatagtaaactaaaaggagttgcagcgagactgtgactcctttttggctttctttctttaaaagaaaaagaagttttccggaaatttttatttaactgtcgtgtacgaagaaaagtttgctataatagaaaaaagcgtgcaaagaaagagggagtttcattatgatgctacgtgtagaaaaattgcgcaaaaaaatgcaagaagaaaatttggattcatttttggttaccagtccgtacaatcttcgttacttaacgaactttacaggtacgacaggattagctgttattactttggaaaatgcattttttattactgattttcgttataccgagcaggcggcagcgcaggctcaaggatttgaaattattaaaaatgtcggacctatttttgatgaggtagcaaacttagtacgcaaagaagaactgcactcattagcttttgaggaaacaacagtctcatttttagaatattcggttttagaagaaatcatcgatgcggaattagtacctgtttcacagatgattgaagaacttagagaagtgaaagatgaagaagaaatcgccattatcgaaaaagcatgtaatattgcggatatggcttatgatcacatcctgaaaatgatccaaccgggcatgactgagattgaagtcgcaaatcaactagacttttatatgcgttctcttggcgcttcaggtgtttcttttgatacgatcgttgctagcggattgcgttcggctatgccgcatggtgtagcaagcaagaaactcatcgaacaaggtgacttgatcacgttggattttggctgctattacgaaggatatgtttctgatatgacacgtacattcgctattggtgatcctggagaaaaattaaaagaaatatatcaagtagttctagatgcgcaattagcggttattgatgctgcgaaaccaggaatgactggtgtacaattagacgcagttgctagaaattatatttcaaaacatggttacggtgaagcatttggacattctacaggacatgggatcggtctggagatccacgaaggaccgaatgtttcttctcgtgcggaaaaacaatttgtaccaggaaatgtaattactgacgagccagggatctacttaccaggaatcggtggggtacgtattgaggacgatttgctgatcacagaagatggcaatcgtgtattgactcgttcaccaaaagaattgatcatcttatagtctcgtccataaaagaagtaagcgtaaaaatcagtgttcacagactttgttatagaaaatcgcttgatttaatgatacactatagaagaacttttaagctgtaagagataataaagttggatattttctccaattcatagcaatttgcagctgatcggcggcagtttttttaccaaatgatcattatagccgcatcatagagaattcggatgtatctcgtgcttaggcaaagggaggaataaataaatggcagatgaaaaaaatttgattttaaacgcaaaccaagatttgggagagattgtgattgctcctgaagtcatcgaagtaatcatcgggattgctgcttctaaagtagaaggcgtatacggaatgcgcggaacttttgccagcaatgtcactgaattattaggacgagcagctcacggaaaaggtgtttacttggcaaatgaggaagatggcttgaaagtagatctttactgctacctggaatatggtgtttcagttcctaaagttgcaatggaaatgcaagaacgggttagccagcaagtccttttcatgacagatatcgatctagctgaagtcaatatccatgtagtagctgttgttcctgaaaaattagaacaaccaacaatcgaagaactttttgaagacgaagaggaagagaatgaataaagaattatcaagacacgtgattcgggagatggcattgcaggctttatttccgttagacttcaatgcagacctaacaaaagaagatgcgattttcaacgcaatcgaattagaccaccgcgacatgatcaatgaagatgaatcagagtttgttcctgtttatcttgatacgctagttggcggtgtctgtgcaaaaaaagatgaattggataaagtgatcgaaaaacatttgaaaaacaattggcatatcaatcggatctcaaaaatggatttggtgatcttgcgtatcgcgatttttgaaatgacttatgtgacagatgtaccagcggctgttgctttaaatgaagcaattgagttggcaaaaacatttagtgatgaccgttcgcgtaaattcgtcaacggtgttttatccaatgtattaaaagaattagaagctggggcgtaagtcctagcttttttctgtgaatcatcataaacctgttataaatcgggaaaattctatggtagaatgaaaacacaaaaaatatctgggagtggttagatggcagaattgattaacggaaaagaattagctgaaaaaatgcaggcagagattgctgaaaaaatccaaaaattgaaagataatggtatccatcccggattagttgttttattggtaggggaaaatccagccagtcaaatctatgtaagaaataaagaacgcgtagcaaaagaaatcggaatccattcatcagtagagcgttatcctgagacgatttctgaaaacgaactacttgcagaaatcgaaaaatacaatcaagatcctagatttcatggtatattggtccaattaccattgccaaagcatatagatgaagaaaagatcctgttagctatccgtcctgaaaaagacgtagacggttttcatccaatgaatttaggcagactccttgcgggtaaaccggacaagattccttgtacgccatacggcatcatgaaaatgtttgaagcttattctatcgatccggcgggtaaacgagcagtagttatcggacgaagcaatatcgtcggcaaaccgatggctcagctgctcttgatggcagatgcaactgttactgttgctcattctaaaaccgaaaatctggctgaactggcacaagaagcagatatcttagtcgtagcaataggacgtggacattttgtcacaaaagaattcgtaaaaccaggtgctgtagtgatcgatgtagggatgaaccgtgatgctaacggtaagctgatcggtgatgtgaaatttgatgaagtggagcctattgcaggctggatcactcctgtgccaaagggtgtagggccaatgactatcacaatgctgatgtatcaaaccgtaaaatctgccgaagcttttggagcaggtgaataaatggcacaagaatatttaactgtcactacattaacgaggtatttgaaacgtaaatttgatgccgatccttatttagaacgggtatatttaaccggtgaaatatcgaatttccgtttacgcgccaatgcccatcaatatttcagcttaaaagatgatcatgcaaaaatatctgctattatgttcaaaggtgcattccaaaaattacgattccatccaaaagaaggaatgaaagtccttgttgttgggcgtatttcactctatgaagcgggaggttcgtatcaaatctatgtagagcacatggagcctgatggaataggtgctttatatcaagaattggaagaacgaaaagaaaagctgatgaaggaaggcctttttcaaggtcctaaaaaaatgttgccgcgtttcccaaagcgaatcgcgattcttaccagtccaagcggagcggttatacgcgatatcatcacgacggtgaaaagaaggtatccaattgtccaattggttttgttcccaaccgttgtacaagggaatcaagcagcggacaatgttgtcaaaaatatccgacgagtagaagagatgggcgattttgatacaatgatcattggtcgtgggggcggatcgattgaggatttgtggccgtttaatgaagaacgggttgcccgagcgatttatcaagccaatacgccggtgatctcatctgtgggacatgaaacagataccacgatcgctgatttagtagcagatgttcgggctgctactccaacagcagctgcagaattagctgttcctgttttgtcagaagagttgatgcgcattcaagaacggcaagctagattgcagcaggcgtttgtacgccagatccagcgcaaacaagaacggttcgagcgtgctcgacgttcctatgtctttcggcagcctgaaagattgtatgaaggtcagaccatcaaattagatcaattgaaacagcgattatatcaagctacacagcagatttatcatgcaaaagaaaagcaaacgatcgcgttaagccaccaattggaacaagtggctccgctttatcgagtcaaagcagcccgccaagaaactgcttatctagaaaaacgtttagaagagaaaatccaacaatatatgaaacaacagcagcagcgttttgctcaagctgttcaatctcttgatttgttgagtccattgaaaatcatgggaagaggctacagctatacgacgttaaatgatcaagtagtaaaaagtgtctccgagattcatcaaggggatttgctgacaatccattatcaagatggaatcgttaaaggacaagtacaagagatagataaaggagaataagaatatggaaaatccaacttttgaagagtcactgcaagaattagaaaaaatcgtcatgcagctagaacaaggagacgttccattagaatcagctctagattcgtttaaacgaggaatggaattaagcaaacattgccaagataccttagctaaagcagaagaaactttgacgaaaatgatgacagaatcaaatgaagaagttgattttgacggaaacgaggaaagctgagatgagattaactgacttttcagctattcatctacctgctgtagaaaaagaaatcttgtcttttttagatgaacatacgacggatagagcgctctgtgatgcgatgacttattcagtgaaagcaggtggaaaaagaatccgtcccttattacttttagcggccgttgcttcctttgatgagcctatcgatgttcccgtctatcaagtagcagctgctttagaaatggtgcatacgtattccttgatccacgatgatttgcctgcgatggacaatgatgatcttcgaaggggaaaacctaccaatcacaaagtattcggcgaagcgttagctatattggctggagatggtttactgacaggcgcattccagctgatcagtatggcacacttgggtcattctcctaagcttctgttgcttcagcaattagctgtttgtgcgggggcacaaggtatggtggctggacaagctgcagatatcgaaggagaatcaaaaaagctttcattagaggaattagcatttattcatgaaagaaagacaggacgtttgattcgttatgccttgctagctggaggtatattagcgaagcaacctgaagaaatcttattgctacttcaacgattagccgaacatttaggtttggctttccagataagagatgatctacttgatgtgattggtacaacgaaaacgttagggaaaacagctggcaaagatgaacgtatggaaaaaaacacttacccgcgtttattaggactagaaaagacacatgaggcgttggagattgagttgttatccgctaataagatcatagacaaattagaagaggacgttttttcttttgatggcaggctgatgcgccagatgatcaagcaatttgatgtggagaaatgagggaaagaatggaaaaagaacgcgtagatgtattagcggtcaaacaaggattatttgaaacaagagaacaagccaaacgttcagttatggctggtttgatttacaacgaaaaaaacgagcggtttgataaaccgggagaaaaaattccagtaagtagtgaattaagagtcaaaggtaaaaaacttccttatgtttctcggggtggattaaaattagaaaaagcgctcaaagcatttgatctatctgttgaaggaaaaacattgttagatatcggtgcttccactggcggatttactgatgcagctttgcaaaatggcgctaaaatgagctatgctttagatgtcggttacaatcagctagcttggaaaatcagacaagatcctagagtcgtcgtaatggaaagagtgaattttcgttatgcaaaacccgaagactttaccttagggattccagaagttgctgtcatcgatgtttcttttatttcactaaaactgatgctgcctccattacatgctattttaaaagaagagggagaagtgattgccttaatcaaaccccaattcgaagcaggcagagaagctgtagggaaaaacggaattgttcgtgacgaacagacccatcaaaaaattttagaagacattttgtcatttgcggcacaaggtggatatgatgtgctggaagtaagttattctccaatcacggggggagaaggaaatatcgagttcttggctcacttgaggaaggtacctgaaagcggcacgatcaatccagctattaatatggcagaagtggtttcaaacgcacacgaacagtttgaccataaataaattgtaactgtgaaaatcaagtgagaagtatgcggattcttctttattataccaaggaaataagctatcattggttaagaagaataagctaaggagcgaagacgtaatgagaaaaaaagatcggcatcgtttgattactcgattgttgagtgagcaagatatccgaaagcaggaagaatttgttgaaatcctgaaaagcaaaggaatatctgttactcaagctacgatttccagagatataaaggaactaaaactgattaaggtaccggcctcagatggcggctaccgttatagtataccagctgaaacaaatgaagatgtaaatactaaattggaaaaactgttaaaagacgctttcgtagcagttgaccaaatggaaaaatttgttactttgaaaactttgccggggaatgcttcggcagcagcgaatttgatcgataagcgctacaagaaagaattattttcgattatcaatgatgacgataatgttttgatgattacacgaactgaagaccaggcagttttactaaagaaagacttcctgcattacctttaagttgaggagcgaatgtgatgctacaagaaatcagtattactaactttgcgattattccggaattgcggctttcttttcacgaaggaatgaccgcgctgaccggagagactggtgcgggtaaatccatcattatcgatgctttaggtttgttagcaggaggaagaggttcaagcgattatatacgtcaaggcgcagaaaaatgcattcttgaaggattgtttgaacttccgaaacaagaaggattctctgaattgatggttgaattaggtatcgaaacggatgaagacaatctgatcgttcgacgagatatgtcgttgactggaaaaaatgtttgccgagtgaatggtcacatcatcacgctagctaatctaaggaaaatcggcagttatttagtggatatccaagggcaaaacgaacatcaggaactgctccagcctgaatcacatcttgctttattggatcgttttggagatgcagctttccaacagaagaaaaagagttatcagcaagaatatacctcttatcgtgagctggaaaaaagggtacgaaaagtgcagcaaaatgaaaaatcctatgttcagagaatagatatgctccatttccagcaagaagaaatagctgctgctgatttgcaagtcggagaagaagagaaattaaaagaagaaagagaaaaacttagcaattatcaaaaaattgctgatggattagctgcaggctacggagcactgacgaataatgaacaaaacagtgtagatggcgttggcttggccgttgcagaattgcaagggatcgcacatctagatatggagtatgaagcaatttatgaaaatatccaaagtgcttactatttgttacaagatgcaatcggagacatgagtcgtcaaatcgatttgttggagttagatgagaaccgtttagaagaagtgactcaacgtctagaattaatccgacagttgaaacgcaaatatggcgaatccattgagtcgatattggcttactatgacgaaatcaccgaagagctagcttcttctgatttttcagaaggtcaattggacaaaatgaaagaggaactagagcaaaaagagcttctacttcagcaacaagccgcagatcttcatgaagcgcgtaaaaaaatcgcaaaagaattggaaaaatccattctgcatgaattaaaaagtctgtatatggaaaacactgagtttgaagtacgtttcttaaaagaagaaaacagacaattgaatcatgatgggtttgaccaaatcgaattctacattacgaccaatccaggagagccgctgaagcctttagtgaaagtcgcttctggtggcgaattatctcggatgttactggctttgaaaacgattttttcttctgagcaaggtgtgacaagtattatctttgatgaagtggatacaggtgtaagtggaagagttgcacaagccatcgcggataaaatttctcaaatatcgaaatactctcaagttttgtgcatcactcatctaccgcaagtcgccgcagtcgccgactatcaatattatatcgtgaaagcagtgattgatggtcgtacgcaaacttctgtttcagaattgaaaacaaaagaaagagaagaagaaattgcacgcatgctagctggaagtgagattacaaaactgacactcgaacatgcaaaagaactattgcaactcgcaagaaggacctgatccacctcgtagtggttcaggtcctttttagcagctgatagctatattttattttttacatgacactcatgacagcagtcaatacaacagacccaatcgttaaaatcagcatcgtccaaatgacaaattttgttactttagcaaaagtacttgtttgttttttttcacgcattgttttcaacctcgtaattaattagttaatccaagtgtacaatctttttgtcttttctacaagaggtcttttttataaaaacttccctttttttaaataataggtagttacgatacaaataaataatgttaataggactagccagataaacgcatcatctctttcagcaatgggtagcttgatgttcatcccgtagatacttccgatgattgttggtatagttaatataatcgttaaagaagttaaaattttcataatattattcaaattattcgatacaattgctgaaaaagtctgattcatttgttctactagttttaattgaatgcgagaagtagtcattgcttgctctgtttctaccaatacatcacgcagatggtttttcaacgcatgattttcttggaaaagtttattttgcgctaattctttcaatgcatctaaattagcagaagtcgcttctctgaaataaacaaggcttttttggatatccatgatttgataaagttgtttgttttcagttgatacttgaagtttggcttccaaagtatcgcattgagattgaagcgtagctaaataactgttataagacagtgtaacctgccagatgaattgaaagaagatattgagattgggtgaaacatcgctttttggaaaggtttgactaaagactttctttaaaaatagtggttcatgattcgtaattgtgataagcttctttttgggcgtcaaaatgatagagagcgggtatgtatccacttgaaaataaccgctaggacttgttttagcaaacggatattgtaacaataataacgctggttttgtcaactttgattgattgaattcttctgtacgggaattttctgcatcgtccaatatggaagtgatgtaatctgacggaatttcaaattgatgtgtcagctgatgaatctcttcttgattgggacgttctacacaataccagatcgtttggtcagtttcctttccggtattacgcagtttctcattatctaatgtaaaatatttgatcatgattttcctcctgttgcctgtttcttttattataacggataggggattggaatacatggaatgtgtttgtaagatatagaatataactgcataaatttaaataaaatgaagcagttgtgtaaagtatatacagtatacttgaagcaacgataaaaaaggagtttacgttcatgggcacattcacaccacttatcttgttttggtatatttacccggtaatcgttttgtttggttgccaatttcttgtaaaattattttcgttaaatcgtcgttttaaaataaaagcccctgatttggcgattccttttttgtggggcggtatgcatgcgttgtctagaaacacagcgacaatttctatcctgccgtttttctttatttctgttttactaatgggcatctgtattgctgtttttcaagcatattattatgaagaaatcatttatccgcgttatttcaagatgacttggcgtttggtatttctgctgacgatcgtcttgtacgcggtcttgatcattgtgaatatactttcttacctatgaaaaaagcagaaaagctgtaaaaagtcttttaaaaggctttttgcagcttgattcttaaaaaaatgtttatgaataaaaaaagttgttcccggatttcctagaaaaggtggtagaaagtgggggattgtggtagactaattttagttagtggaggaatggggggctttcaatgttgatgggtgaattccaacataatattgatgcaaaaggacgtttaatcgttccctcaaaacttcgtgaagaacttggcgaaaagtttgttctgacacgcggattggatggttgtcttttcggctatccgatgagcgaatgggaaaatctggaagctaagctgaacgaaatgccgttggctaaaaaagacgcacgtacatttgtgcgattcttctattcggctgccactgaatgcgaacttgataaacaaggacggatcaatataccaagcacgttaagaaattatgcagctttgacaaaagggtgcgtaatcatcggcgtatctaaccgaattgaaatttgggatgagacacgatgggaagatttttctgcagaagcagaagagaattttgacgaaattgctgaaaatatgattgatttcggactataagaataggaagaggctgactaatgactgaaacatttcaacactatacagtcatgttgaaagaaacggtagatggattgaacatcaaaccggatggcgtttatgtagactgtacactcggcggtgccggacatagtgaatatttattgagccaactaagttctaaagggcacctgtatgcgtttgaccaagatcaaaaagcaatcgattacgccaagctgcgtttagcttcttatgtcgaacaagggatggtcacatttatcaaagcgaatttcagagaattagaagaacgcttgagtgagtatgtagataaggtagatggtattttgtatgacttaggggtttcctctcctcaactagatgaagcagaacgtggatttagttatcatcaagatgcacccttggatatgcgtatggatcagtcagctcctttaaccgcttatcacgtaattaatgaatattcctaccatgaattagtaaagattttcttccgctatggcgaggagaaattttccaaacaaattgctcgtgaaatcgaacgagtacgaaaaacaaaaccaatccaaacaactggtgagcttgtcgaaatcattaaacaagtcatcccagctcccgcaagaagaaaaggcgggcatcctgcaaaaagaatttttcaagctgtgcggattgcagtaaatgacgaacttggtgccgaagaggcctctttagaacaggcaatccggttattgaaagtcaatggaagaatcagtgtgatcacattccactcattagaagacagaattgtcaaaagtatgtttaaagaatatagtacggttcaagatttaccaccgggacttcctgtcatacctgacgaatttcaaccggaactgaaagtcattactcgtaaaccaatccttccttcagaggaagagttagcagaaaacaatcgatcacgcagtgcaaagttacgtattgcagaaaaaataagaatgaaagaggagtagaatgatggcagaattaaagaaaatgcaagagtacgaatatgatttacctgaattggtggatcagccagaacaacaaatgccagattcttcttcgaatcaagaaatcattcttccacaatcaccagcaaaacgattgaagcagatttctgctttggaaaaaattgctgtggcaagcgtggcgattgctattgttgctttgtgtgttttaacagtcatgttgcgtacaaatatcagcggagctgaaaaagaaatcacatcaatacaaacagaaatcaaggataaaaagcaagaaaaaacgagtttagaacaagaaaaaaatgaactttctcgtactgaacggattaaacaaatcgcagaagaaaaaggattgtctattaatgacgacaatttaaggaaagtgaagtaaatgagtcttaaaaataaaattcggcggtttatggaaaagaaaaatctaaatccgatgaacaatcgcaaaaaagtaggtatcattttatttgctacgagtattggattgttctttttatttgccgtccgtttctcgtatatcgttattggaggtcatgttgctggtacctcattagctgaaaaaacaaaacagttgtaccaaggaagtgaagtagtaaaagcaaaaagaggaacgatttatgatcgtaacggtgtggcgctcgcagaagatgcctcctcttattcaattaaagcgatactctcaaaaacatatacttctggggataaaaagctgtatgtcgaagaaaagaattttgataaaatagcagaaatcctgcataagaatctttctatagacaaaaaagatgcactgaatattttagaagacggcgcaaaaaaagagctgtatcaagttgaatttggtagctatgggaaaaatatctcccaagaaaccaagcaaaacatcgaagcagatatgaaaaaagaaggtgtcgctggtctttactttgtcgaccatcaggctcggatgtatccaaatggcgtcttttcttctcattttatcggatatgcagttccagacaaagatgagaatggcttagttggtaaactaggtttggagtctgcttacaatgatattttgagcggtaaagatggtaagattatttatcaaaaagataattttcaaaatcctctgccaggtacagtagcagaagaagaaaaagctgttgatggacaagatatctacacgactttggacagtagactacaaagttatttggaaacactgatggatcaagtaaatgaagaatatcaaccggaagaattgacagcagtcttgatgaaagcaaaaactggagagattttggcgatggggcagcgtcctactttcaatcccgaaacaatggaaggtttgactggagaagatgctatctggcgtaatttcttggtacaagatagttatgagccaggatcaaccatgaaggttttcactactgcagccgctatcgaagaaggagaattcaacgagaatgaaaccttccaatctggaaaaatccaagtagaagatgcgacgatcaatgaccatgactttggtgaaaaaggtgtgctgaccatgcgtcaagctctttcatggtcaagtaacgtcgggatggtcatactggaacagcgattaggcggacgatggtacaattatttacaaaaactaggatttggacaaagtacccattctggattagatgacgaagtaaatggtgctttgcctacatcaaatattgtcgaccgagcaatgagtgcttatggacaagcggtaggtgtgacgaatttccaaatgatgaaagctttcacttctattgcgaataacggtacaatgattcaacctcgatatatcagcaaagtagtggatcctcaaactggagaagagcgaacaactcaaacagaagttctaggacaacctttttcaaaagaaacaacagaaaaagtccgtgaatatatgagagatgttgtcgaaagcgaaaactacggtagtgcttatggcgtatatagtgtacctggatacaatgtatcggcaaaaaccggaacagcccaaatcgcttctgatacagggggataccaaacaggagatacagcctacctgtattcgattgtggagatggttccttctgaagatccagactatgtcttgtatctaacaatgaaacaccctaagacatatgatcgaatggctttggctaaaatcgcaaatccattgatgaaacgggcaatggattttaaagaaactgaagaagatacggatacagaaaccaaaacagaaaaagtatccgtagccgattatcgtaatctagaagcagatgttgcagcagcggatgctcaaaaaagcggactgcaacctgtcgttatcggtaacgggaaaaaagtacacaaacaatctactgccaacggtgatcagttgatctctggagaaaaactgattctatatactggcggcgacaagctgatgcctgatgtaactggatggtcaaaagcagatatcatgaagctagggaaaatccttggtatcgaagttagttttgatggggatggttattgtgtcaaacaagaacttgctccatatgaaaaaatcacaaaagaaaaacttaattttactttagaagaataagaagagaaataggagagaaaagagcatggaatggacacaagcattgattcccattgtcagcagttgtgcaatgacgattgccgcaatgccgctatttattggttactttcaaatgaaaaagcaaggtcaggcgattcgcgaggagggaccaaagtggcacaatatcaaagccggaactcctacaatgggcggcttagtgtttctgatcggctctattttgacagggatttgggttggagcttggcaaaaacagctgactcctactcttttcatcttgctttttgtattagcattatatggagtaattggttttcttgatgattttataaagatcttcaagaaaagaaacatggggctgaactcgaaacagaaactgattggacaggttctagggggaatcatcttttatcttgtttaccgttctgaaggctatccaggtgtattgaatttctttgggctggatctgcctttaggaatcatttatggggttttcgctatcttctggcttgttggattttcaaatgcggtcaatctgacggatggtatcgatggattagttgctggcttaggcagcatctcttttgcagcttacggtctgattgcttggcatcagcatcagtatgatgtattaatcatttgtctcagtgtcttaggtggtttacttggattcttcgtctataaccggaaacctgccaagatttttatgggagatgttggttcattagctttgggcggacttttagcggctatttctatgatgctgaaccaagagtggacattgcttttgattggcttgatttatgttatggaaactgcaagtgtgatgcttcaagttacatcctttaaacttacgggaaaacgaatttttaaaatgtctccaatccaccatcattttgaaatgtgcggatggtcggagtggaagattgatacagttttttggttgatcagcattgtgacttcattgatcacattatggatcgtttggtaggagatgacaggaaatgaaaaaaatatcaacatatgaaaataaaaaagtgcttgtcttaggactcgcaaaaagcggagtaagtgcggccaaattattacatgaattgggcgcacttgtcaccgttaatgacggaaaaccttttgatgaaaatccggaagcacaagaattgctttctttagggataaaagtaataacaggcagtcatccaatcgaattactagatgaagaattttcgttgatggtcaaaaatcccgggattccctacagccatcctttagtagcaaaagcccaagaaatgggtattccggtaattacggaagtggagctagcttacgaagtagcggaatgcccaattattgggattacaggaacgaatggaaaaaccacgacaacaacgatgactggactactactgaatgcaggcgtagacaaaggagttgcacgtctagcaggaaatattgggtatccagcaagtggtgtcgcggaagaagcgaaaccagaagataaaatcgtgatggagttatctagttttcaactcatgggaatcacagatttccatcctcatatagcggtgatcaccaatatttatgaagcacatattgattatcatgggacaagaaaagaatacgtcaaagctaaatggaaccttcaaaaaaatatgacagctgaagattatctggttcttaactggaatcagtcagaactacaagaattagcgcaaagaacaaaagcacgcgtcctgcctttttcgacaaaagaagtgttggaagatggtgtgtatgctgacgatcacgcaatttattataaaaaagaaaaaataatggaaatctctgaacttggcgtaccaggtacgcataatgtagaaaatgcgttagctgctattactgtagcaaaattgtatggtatatcaaatgaagctatacgacaaacgttgcatttattccatggcgtgccgcatcgtacgcaatatgtaggagaaatccaaggcagaaaattttataatgattcaaaagcaaccaatattttagcgactaaaatggctctaagcggatttgaaacggctaaggtcgtgttattggcaggcggattagatagaggaaatacatttgatgaattggttccttcactaaaaggtatcaaagcaatgatcgtatttggtcaaacaaaagaaaaattgatcgatgctggaaaaaaagcaggcatcgaaacgatagtaacagccgattctgtagaacaagcagttcctttagcattagaaaacagtacagatggtgatgtgattttattatcaccagcgaatgccagctgggatcaataccctaattttgaaactagaggaaaccgattcatggaagttgtgaatcaattaaaatagaaaaagtagaagcgagcgataaaaaatgaaaattttggttacgggcggaggaacgggaggacatatttatccggctcttgcctttgtcaattatgtgaagactcaagaaccgaatgctgaattcatgtatgtgggagcaaaacgtggtctggaaaataaaattgtccctgatacaggaatgcctttccatactttggagattcaaggctttaaacgaaaaatttccatgcataatatcaagacaatccgattgtttcttaagagtatccgtcaagcaaaaaaaatcctcagtgattttcaaccagatatcgttatcggtactggaggatatgtatccggagcagtagtgtatgctgcatcaaaaatgggaattccaactattatccatgaacaaaacagtgtaccaggtgttaccaataaatttttaagccgatatgtggatcggatcgctctttcattcaaagatgcggctcctttttttcctgaaaacaaatcagtccttgtaggtaatcctcgagcacaagaagtagcagatactaaaaaatcagatattttgaaaacatttgggttggatccagaaaagaaaacagtcttgatttttggcggcagtcaaggagcacttaaaatcaatcaagcggtatcggtttttttaagtgaatatattccttcctcttatcaagtcttgtatgcttcaggagaaagatattatgaagaaatcctaaataaaataaatcctgaaatacaaaatattagtgtccagccttacatcaaaaacatggcagaagtcatggcttcgagcaatctgctagtgggacgtgctggtgcaacttcgatcgcagaatttacagctttggggcttccggcagtgttggttcccagtccatatgttacgaatgatcatcagactaaaaatgcaatgagtcttgttcatgcaggagcagcaaaaatgattgcggataatgagctaacgggtgaatcactaagtcagacaattaacgaaatcatggatgatgaagaattgcaaaagcaaatgtgccgagcttctaaagaacaaggcatccctgatgcttcaaaacgtctttatgacgtagtgaatcaaataatcaaaaaataaaggcggtggtcttagtgagtaagaaaaaagaacctaaaaaattgtctcatccgtcttctgatgaaaacaatttgactccttggcaaaaggctaaccgaaaatatctggcagaacaagggatgaaaaaccaagagccaaaaaaagaagacacaccattagacacacccctttcagattctgaagaagaaaaaacggttcaagaggaacagcaagaaacaagccagtcagaaagccagtccgagaaaaaaatcgaattttttgaagagatcaagcaaaagaaaaacggtggcccgtataacggttcttttttgaatcgtctccctaatttaaaaagtcaaaggcataaagtactgtttcgtcggttagcattgattattactgtattgggcataccgctgatttttttgatctattatgtttctccttatagcaagctacaagcagttgcagtgtcaggtaataaggtagtcaacagtcaggaaatcatctctgataccaaattgtcattgggagaaaatgtctgggggcagtatttcgatcgatccacttatatcgaacggctaaaaaaagcacagccgagaatcgaaaaagcagctatacacttcaaagggataaatgagttcgatttggatgtgacagaatacaaagaaatcgctttgattgcaaaagataatcaatactatccagtaattgaaaatggaacagtattagatgaaaaagtagcaaatcctacaaaaaatctccctatcttagaagagttcaaagattcagcaaaaatcaaagaattaacaaagcaatacaatcagttatcatcagaattgcaaaaagcaatctctgaaatcaagtatacaccaagagcaagtaataaaaacctgatccaattgaacatgaatgatggcaatcaagtcattgtaaatatcaataatcttgcgaaccaaatgaaatattattcgcaagtagccaaagacatggatgaaaaaggtgtgatcgacatggaagttggcatctactcatatccttacagcagtactcaagaaacggcagaatcggaccaaacgaaagaaacaactggaagtgaagaaaacgcggatcaaacaaatgggtcaagtgaagaggcagaaacgcaagcagcagatacacctgaatcgtctgatataaacggctcatctgattcaaataattcaagtgaaacaagtcaaatagaagacaatccaagtacaactccgtcaagtttaaatgaaaattgataaaacaactttaaaaagtaagaatgtactttctaaaaaccagtaatttatggtagaattgaaagcagtgaatatatctattaataagtatattttaaaacggacgctagttgttcgcttgtatatggaatagtaagtaggagggaatcccattcatggcaaaaacaggaatgtatgtaggccttgatattggaacgacatctgttaaagttgtcgtggctgaatatatcgacagccaaatgaatattattggagtaggaaacgcaaaatcagaagggattaaccgaggcattatcgttgatatcgataaaacggtccaagcgatacaacgagcagtacgacaagcagaagaaaaagcaggtatccagatcaaaggcgtaagtgtcggtttgccagcaaacatgcttgaagtagaaaattgccagggaatgattgcagttaacggagattcaaaggaaatcaccgatgaagatgtcagaaatgtggcttctgctgcccttgttcgttcaatacctcctgaacgtcaaatcgtgtcaattttgccacaagattttactgtcgatggattcgagggaatcaaagaccctcgtggaatgatcggcgtaagattagaaatgtacggtctgttgtttaccggaccaaaaacgatcatccataacatacgtaaatgcgtggaaaatgccggattaatcgtcaatgaaatggtgattactcctttagcgctgacagaatcaattctttctgacggagaaaaagattttggtacgatcgttattgatatgggtggtggccaaacgacaacagctgttatgcatgataagcaattgaagtttaccagtctcgaccaagaaggtggcgaatttgtcactaaagatatctctattgtattaaatacgtcttttaacaatgcagaagcgttgaaaataaattacggggatgcatatccagaacggacatcaccagatgaagagtttccagtagatgtaattggccagtcagaaccagtgaaagtcgatgaacgctatttgtcagaaattatttcagctcgtatggaacagattttcaacaaagcaaaagatgcattggaccaaatcgaagcattagagttgccaggtggcgtcgtattgacaggcggagctgctagtcttccaggtgttgtggacttggcgcaagaaatcttcggcgtaaatgtgaaactgtatgttccaaatcacatgggactgagaaacccggtatttacaaatgtaataagtatcgttgattattcagcaaacttgagcgaagtgtatcaattggcaaaaattgctgttacaggtgagacctcagcagctcgtcaaatggtagttgaacaagaaacaacaaacacatatgaaagctatgaagcacctgaagaaacagtctacgatgagccggaaccaaaagaatccggagaaaatgtaaaaaataaaatcaagggtttctttacaaatatttttgattaattcatcctgggaggaataagatatggaattctcaattgataataatatcaatgacggcgcagtaatcaaagtcatcggagtcggcggtggcggtggaaatgctgtgaaccgaatgattgaagaaaacgtcaaaggtgttgaattcattacggccaacacagacgtgcaagcattaaaaaattcaaaagctgaaacagttatccaattaggaccaaaatatactcgtggtttaggggctggttctcaaccagaagttggacaaaaagcggcagaagaaagtgaacaatccttacgagaagctttagacggtgcagatatgattttcatcactgcaggaatgggtggaggaactggtacaggtgctgcgccaatcgttgcagggatcgctagagaactgggcgcattgaccgttggtgtcgttacacgtccgttcacttttgaaggacctaaacgtggccgttttgctgcagaaggtatcgctcgtttgaaagaaaatgtcgatacattattgattatctcaaataaccgtttactagaagttgtagataaaaagacaccaatgcttgaagctttccgtgaagcagataacgttttacgtcaaggtgtacaaggtatctctgacttgattacggcaccaggttacgttaaccttgactttgctgacgtgaaaacagtgatggaaaaccaaggtacagcattgatgggaatcggtgtagctagtggagaagatcgcgtagtagaagcaacgaaaaaagcaatctcctctccattgcttgaaacatctattgatggagcggaacaagtacttcttaacatcacaggcggtttggatatgacattgtttgaagcacaagatgcttcagatatcgtagcaaatgcagcaactggcgatgtaaatattattctaggtacatctatcaatgaagaaatgggcgatgaaatccgcgtgacggtcatcgcaacaggtatcgatgaatcaaaaaaggagcgcaagtctagccgtccagctagacaagcacaaatgcaatcacctgctcaaaagactgtattagatatggatcaagctaaaccaacttctgcagaagaagaaaacagttttggcgattgggatatcagacgtgaacaaaatgttcgtcctagagttgatgattccaattttgacaatatcgaaaaaaaagaatttgatacattcaaccgcgaagaaacaaaatctcatggcgatgatgaattaaatacgccaccgtttttccgtcgtaaaaaataaaggagaggaagagcacatgattgctgacaacttgcagaaaatcaagcaagaaattcaggattcgtgtgctcttgttcatcgtgatccgaaagaagttacattagtagctgtaacaaaatctgttgaatcagctcaagctgaagaattgggcagagctggcgttatgaattgtgcagaaaaccgagtagataaactattacaaaagaaacaagatttatttgattttcccgaaataaagtggcatttaattggtaatttacagcgcagaaaggtaaaattgattgtaaatgaaattgattactttcatgcgttggacagtttaagattagcagaagaaatccagaagcggttagaaaaagaattatcctgttttattgaagtaaatgtttctggtgaggaatcaaaacatggaatttcaccagatgagcttttaccgtttgtggaatctttagctgcctgcacaaaaatcaaggttgttggtttaatgactatggctcctaaagaatcttctgatgagcaaatccataaagtgtttggtacgctgaaagaattgcgtgatcttgttcaagcaaaaggttatgcccatgcaccatgtaatgaattaagcatggggatgagtcaggattttcaaattgcgattgaagaaggtgcaacatttatccgtgtaggaacagcgctattcaaagacgaataaaggaggaacaaaaatgccgcttttaaacagaggagcaattgctaattttttcggattagctgatgaggaagagtacgaataccaagattatcctgaaacaacaaaaaaggctgtacagccaactaaaaaaaatataacacagaatcaaccaactcattctgtatctgctgcgaatactcatgagaaacaaaaaacggcgacttcacgtcctgtaacgcatgaaagtattcagccggctgaaaagaaaaaagtaattgaactacatcaatcacctacaaaaactgtagcgaaagaaagaacagcttcaagaacgtctacacaacctaaagcaaatcttgcgggaaaaatcactgtgatggaaccaagagcttattctgaagcgatggcgattgctaaaagaatcatcgctggagaagcaaccttagtgaattttcatttagtggaagaaaagcaagcgagaagaattgttgattttctaacaggaacagtttatgcattagatggagatatcaaacgcgttggagatgagatttttctttgtacaccgacagggatggagattgacagttcaaccgctcaatcttttgcagatgcgaatttgtttgatctgtaagaggaggaactacgatttatattattgcgctattacttcatttaattcaacgggcagcctatttctatagcattatcttgatggtatatgctttgctctcttggtttccaggcggttatcaatcaggattaggacggtttttagctaagatctgtgaaccgtatatcagtttattcgatcgtctgcctttaaggatcggtcctttggatttcacgattttaggggccattctaatcttgaacttagccgtacaaggattagcacagatcgttatatggataactatccatttagtttattgattcaagcaataaaatctttattctcagaatagataggaggggaaaattttggatgcaaatgtataccagcactttcgggcagatgaacgtgcatttatcgactcagtaggtgattggattgaacaagttcaaggacaatatgcgccatatctgactgaatttcttgaccccagacaatcctatattttagaaacactgattcgtcaaagcagtgatttgcgtttcatgttttatggtggatatgaacaggcagaaagaaaaagatgtttgattttccccgattattacgaacctgtagaggaagattttgaaacagcattgtatgaaatccattatcctagcaaatttgccagtctaagtcatgggaaaatccttgggactttagtgggaacaggtatcaaacgctcttactttggcgatatcatctcagatggcgatcgctggcaagtatttattgcaaatgaggtggatcattttgttgctgcacaagtaacaaagattggaaaagttgctgtacgcttggaaccaatcaaatacacagaaatgattttgccgaaagacagctggacacaagaaagagggactgttagttctatgcgactggacagtgtgatctctgagatttataatatttccagacagcggtccaagcagctgatcgaagctggtaaagtaaaagtgaattggacagaaaatacaagacctgattttgtacttgaactattagatattatttcagtcaggggttacggcagagtccagatccaagaacttgaggggaagacgaaaaaagaaaagtacagggtgttgttcggtgtattacgtaaataaaataaaaaggtggtttactcatggctttaactccattagatatccaaaataagacattcccaacaaaaatgcggggatataatcaagacgaagtagatgatttcttagatttagttgttcgtgactatgaagaattgactcaaagaaatcgtgaattagaaaaagcagtcaaacattcagaagaaaaacttgagtatttcaatgaattgaaagatgcattgaaccaatcgatcatcgtagctcaagacacagcggataaagtaaaaacaagtgcaagtaaagaatctgaagtgatcgttacttctgcacaaaacaaagcagatgagttagttgcgaatgctgaaaaacgtgcacaccaattaacaactgatgcagaagaaaaagcaagaaaaatcttgacagatgcaacagaaaaagcaagacagcttgcgacagaaacagaagatcttaagaaaaagacacgagtattccatcaacgtatcagcttgatgcttgaatctcaattggaacaagtgaaaagtccagaatgggacgaaattttacaaccattctctagctatgtgactgacagccatgaagtgatcaaagaagttttagcaaaacagcttgacaacgaaaatgatactgatgtaaactcagacacaggagtcatagaagcacctatgacggcatttgatacacaggctatcgatatctcaatcgtacctggtgaacatgaaaacgagtagaacagaaaagcactttgttattcttaaagcgagccgatgagagtggaagatcggtaagacactgcatcgtgaaagatcctctacttgagactgcttttctgaaactagagtaagaagcagcggctgacctcgttattggtcacagagagtttgcattagatagatgcaactaaatttgggtggtaccacggcatgttcgtcccttgcggctgaacatgcctttttgtgtccggaaaataaacgaaggagtgaatggttgaatgaaaatgaaagaaaccttgcaattaggaaaaacaaaattccctatgcgtggtaatttgccaaaccgagaaggcgaatggcaaaaagaatgggaagaaaatcaaatctaccaaaaaagacaagaattgaacgaaggaaaacctagctttgttcttcatgatggacctccttatgccaatggaaatatccatttagggcactcattgaataaaatcagtaaagacattatcattcgttcaaaatcaatgtctggctaccgcgcaccatatgttccaggatgggatacacatggattgccaatcgaacaagtgttggctaataaaggcgtgaaacgtaaagaaatgtccatggcagaatatttggaaaaatgtcgtgaatatgcactttcccaagtagataagcaacgagaagatttcaaacgcctaggggttgcaggagattgggaacatccctatgtcacattagacccttcgtatgaagctgcacaagtacgcgtatttggtaaaatggctgaaaaaggctatatttacaaaggattgaaacccatttactggtctccgtcaagtgagtcttctttagcggaagctgaaattgaatataaagatgtaaaatctccatctatttttgtagctttcaatgtcaaagacggcaaaggcatccttgatgaagatacagctttcgtcatttggacgacaacaccatggacattgccagcaaaccaaggtattgctgtaaatcccaaatttacgtatgtactggtcgaagctgatggccgtaagtttgttgtagcaaaagatttgctagaaacagttcaaacagaaatcggttgggaaaatgtaacggttctaaaagaatttgctggacaagaaatggaatatatgactgcaagtcatccattctatgaccgtgaatcgctcgtaattttaggtgaccatgttactttagacgctggtactggattagtccatactgctccaggacacggggaagatgactatatcgccggtagcaaatataaactatctgtagtgtcacctgtagactcaaaagggttgtttacagaagaagctcctggatttgaaggaatcttttatgataaagcaaatcctatgattactgatttattaaaggaaaaaggagctttgctgaaactagatttctttacccatagttatcctcatgattggcggacgaaaaaacctgtgatttatcgtgcaactccacaatggtttgcatctatcgataaattccgtcagaatattttggatgaagtagaaaaagtagattgggttattccatggggaaaaacacgtttatataatatgatccgtgatcgcggcgactgggtcatttctcgtcaacgtgcatggggagtgccgcttccgattttctatgctgaaaatggtgaagcaatcatcacgccagaaacaatcgaacatgtagcaaaattattcgctgaacatggatcaatcatctggtttgaaaaagaagcaaaagaacttcttcctgaaggatttactcacccaggttctcctaatggcgaatttacaaaagaaaaagatatcatggatgtctggtttgattctggttcttctcatgaagctgttttacgtcaacgaccagaattatcattcccagcagatatgtacttagaaggatcagaccaatatcgtggctggttcaactcaagtatcacgacaagtgtggctatcaatggcgtagcaccatataaatcagttatttctcaaggatttgctttagatggcgaaggccgtaagatgagtaaatctttaggaaatatcattgcaccagaaaaagtgatcaaacaatttggtgcagatatccttcgcttgtgggtatctagtgtcgattatgaagcagatgttcgtgtatcgatggatatcttaagtcaagtggcagaggtatatcgtaagatcagaaatacgatgcgtttcttattagcgaatacagaagatttcgatcctaaaaaagatactgtttcgtacaatgatttacgctctgtagacaaatacatgaccgtacgattgaaccaagtaatcaaagaaatcagagaagaaggatatgacaaatataatttcatgcatatttatcgtacagttatgaacttcttgactgttgatctatcgtccttctacctggattttgctaaagatgtggtttatatcgaagcagaagatgattatcaacgtcgttgcatgcaaactgttttctatcaaacagctgtagctttgacgaaactattgacgcctatcattccacatacggcggaagaaatctggtcattcctgaaagaagaagaagcatacgttcagttaagcgaatttcctggctatgaagagtttgcgaaccaagaggaattgatggacacttgggctgctttcatggatttccgtgacaaggtcttaaaagcattggaagaagcaagaaatagcaaattgattggtaaatcattggaagcaaaactaactgtttatccaaaacaacaagttcgtgaaatgttaaaagctttggatgcagatattgcacaattgctgatcgtttccccagactactttgaagtaatggaagcagatgtacaagtgccagataatgctgtggtatttgatgatgttgctattacagtggaaaaagcagacggagaaacgtgcgatcgctgtcgtcaagttcgtaaagatgtaggagtagatgaaaaacttcctcatctatgcagtcgttgtgcaaaaatcgttgaagcattctatcctgaagctgtagctgaaggattcgaagaaaagtaaaatggaaaaggggttgtgacatgttttttgtcacaaccccttttgttatcaatcgattaattttccacgttcgcgataccagttatctggttgccagatccattcgaatccgtctttttcaagtaattcgaaagctgctttaggccccattgatccggccttgtagtttggaaagtccggttgtgtttggtcccaagctttgcgaatgacatccacgatatgccaagattgagcgacttcttcccaatgagagaaattcgttccatcaccattcaacgcatctagcagtaatttttcgtaagcttctgggctattttcaaccatttctgcactatttcgaaattctaatttgattggttccgtttcaaacccttgacctacttcttttccattcagggataaagaaaatccttcagttggctggatatagatcgttagaacattcggtgggagtgtcgtatcgtcacatggttcatcgacagatgttttgaatacattaacaggaacctgtttgaacacgatattgatccgagtacctttttcagtcaaacgttttcctgtacgcacatagaagggaacaccagaccaacggaagttgtcgatagtgaattttcctgcgacgaaggtttcggtctctgattgagcatccactttgtcttcttctcgataacctttgaattgtacgccatctaattcaccttgagcatattgtccacgaacgaagttttctaacacttcttcttcgttgtagatgcggattgctttcaatgctttgatcttttctgtacggatttctttttcggaaaatgctactggtggttccattgcaagtaatgctacaacttgcaaaatatgattttgcaccatatctttcagtgcgccactatgatcgtagtagcccccgcgatcttctacaccaaggttttcaccaaaagtgatttggatattatcgatgtaacgattattccattgagcctcaaaaatattattggcaaaacggatagctgagatgttttggatcatttctttccctaaataatgatcgatcctgaaaatatcttgttcagggaatacttctctgatttgctgattcaattcgaaagcagattggtaatccgatccaaacggtttttctataatcaaacgattgaagccattttttgtcataatgttttgtgattttaaatgagaaacgatcgttccgaaaaattgaggtgccatggccaaataatagacgcgattgccgtttaactgatagtgtccatctaatcggtcagacaattcttttaatgtttgataatgtgttgaatcatttacatcatgggattggtagtaaaaatgactagcaaaagtagttgcttcttcatcagaaggattcaatgcacggatcgtttctttgacaacttcacggtagtgttcatcgctccaaggacggcgagcggtcccgatcacggcaaaatgctcgcctaaatttccttttctgtacaggcggaacaaagacgggtacaatttacgttgggctaggtcacctgtgccgccgaatatcgtaaacaatacatttttttcattagacatgtagatacactcctttatattttatcgacaaaaatcgtgctggccgccttgaagctgacgggtattttctttctatcattttggatagtgattggtccttcataagctgcgatatcaacgatctcatactcttcgttgatattcaggtcaattgtgactaagtaatccaacaattctttttcatcaagcactcgtgcgatacgcacttttgtaccgacaggataagattctagtgtttgccggcgttcttcatggacgacttcctcttttttaggaatcgatcctccatgaggacaatgttcaggatgattcaaatagttttctaaatgatctgcaagatgttccgaagtcacatgttccaatacttcagcatcatcgtggacttcattccagctatagtctaaatgttcaactaaaaaaacttcccataaacgatgtttgcgaatcaaactgctagctttttgcagtccgcttgcagtcaattgtacaccttgataaggggaatgttctacaagctcttctttcacaagtttagaaatcatttcactgacagacgcagccgagacatccaggctagatacgatttgtttattgttgactttcgttgtatctccgcctagttctaaaatgattttcaaataatcttctcgatttggtgtcatattcgatcatcctttcatggtaaaaaccatcattagtaagtgtaacaaaaaaaacgttaattgactatttttctaaataaaaaacaaaggatttttggacgtttttacaacaaaaaacgaaagacgagaaagaagactcatactttcgtttatagatatatattgggaggtgtctatttttcagatgtcaacttatacgagacatctgcagattcatcataaagagtttgttcgggataagaaaagacaagataaaaaccatattgatcacgtacgactaaacgctgttcatctatttctactacagatgtgccaagtgactgaccgttgatcaaaaacgtgtaatcagatgtaatctgtaattgttgtttttgctggctatcactgaagaaccatgtaccttgatacctcgagagtctttcagatttttccgcttgttttttctttttcaagtaaatccaacttgagagaacggcaacgagtgagccaagaaaatagatcattttttttatcaccaaatcactcctttatgagaaaatcatcgtatagaaacattcttccttcttcatttcattgtaccgaataaaaactaaaatttctctaagactttcgactggtttttttactgtttttccacaaattatgataggatacatagtaggaagacaggtgacataatttgaagtatcagcaagttgaaacagctttttttattgaccgcccgaatcggtttattgcacattgcatgaaaaaagacggagaaatgattatcgcgcatgtcaaaaatacaggcagaggaaaagaggtcctgataccgggcgctgaagtggctattgtatttgctcctggacctaaaaggaaaaccgactatgatctgattgctgtaaaaaagaagggtgattggttcaatatcgatagtcaattgcctaatcagttagcaactgacggtattttagacggcacgatccttttaccaggattaactggtccatttacagcatgcaagcgggaagtaacttatcttcactccaaatttgatatttatttggagacggcggccggacaaaaagcatttgttgaagtcaaaggtatgacgcttgaaaataaagcaattggtgcttttcctgatgcgcctacactcagaggattgaaacatgttggagaattagcgtatgccgcacaagatggttatgccgcttatgtcttgtttattgctcaattcgaacatcttcatttcgcaacgatccatgaagaaatgcaaccagcactagctgatatggttcgacatgcgcagcaaagtggagtgcaaatcctcgcctataattgtcaagtaacggcagatgaggtaactgtcaagcaggctatcccatttgatgtagctatcccgtttgaagatcctatacaatagaaagaaggtaaaaaaatgatcaacttaggtattattggaacaaattggatcactcatcaatttgtccaagcagctttgagcacaaaaaaatatgaattgacagcggtatattctagacatttagaaaaagcacaggaatttggttctcattatgaaggggatatcgaatttgcaacagatttgaagacttttttcaatattgctcatatggacactgtttatatagcttctccaaatagtcttcattttagtcagactaagcaagcaattttggcaggtaaaaatgtaatagtggaaaagccagctttttcgacgccaaaagaaatggatgaaatcatccatttggcaaatgaacacaatgtgtatttttttgaagcagcaagaaatatccatgaatcaggttttaaaaagattgccgattacttaccattaaaagacgagataatcggtgcaaatttcagctatatgaaatattcttcgcgttatgaccaagtattagatggagaagaaccaaatatcttctcgactcatttctcaggtggtgcattgatggatttaggtgtttaccttgtgtatgcaactgtcgcttggtttggaatgccaaaagaagtccattatttcccaagaaagatttctactggtgtggatggtcttggatggggaatcttgcgttatgatactttcgatgtatcgatccaaccaggtaaaatcggtgattcttatctgccatcagagatctattttgactcaggaacgctagtgatgaatggcgtcaatgcaatcgaacaagcagagtttcatgatcgggtacacgaagaaatcattgacttagcagtaacagctgcagaaaatccaatggcagatgaagcagaggattttgccaatgtcatgactcatccgaaagatccagcttggggattattgtatgaagagtggatcgagctagctagaaatgtgaaccaagtgatttatgatttaagaaaaaatggtggcatcaaattcgatgcagataatgaggaagatttttaatgaacgaatttgtacaagtatttcccgaaaattggcagaaaaattatgagaataaaggatttattacaccttctcttattcaacaggcagtttttcagccattaagcaataaacaaagcatagtagccatctctccaacaggttcaggtaaaacactggcttatctttggccgttactactaaacgtagaaccaggtgaagcaagtgcgttggttatctttgcatcttctcaagaactagctattcaagtagcagatgttgcacgtgaatggggaaaagacaaagaattgaaagtccaatctttggtgggcggagcaaacgttaaacgacaaattgaaggtttgaagaaaaaaccagaaatcttgattggtacaccaggaagaatattggaattgatgaaagctaaaaaaataaaagcacatcaagtgaaaacaatggtatttgatgaagcagaccagctatttgatgcggggaacagccaaatcattgatcagattcttcatcaagctccgacagaatatcagctagcctttttttcagcaacagcagatcgttcccttgaaagcattgaaaaaatcactgggaaaacgtttgagacgatcgacgtgacagcagaagatgattctcgaaaaggcttgagacattactttttacgagtgccaatacgaaagaaagatgaatatctaagacgtctcactcacatagaagattttcaaggtctgattttctttaatcaactgactgaattaggtgtgatggaagaaaaattgctgtatagaggggtacctgtaggaagcctggcctctgatcaaaacaagctgctccgaaaagcggcgctggaacaattcaaaaagaaaaagatcagcgcacttttgaccacagatgtggcggctagaggtttagatattacaggacttccttatgtcgtgaatgcagaagtgccgttaagtgaagaagcttacttgcatcgttctggaagaactggacgaatgggcaatgaaggaacagtgatcacactcgtacaagataacaatttaagagatttgaaacgacttttacgtccgacaaacataacacttgaagagatttttctgcacggaggaaagttacaaacggatcaaccaatcaaagaagatgtagctaccgcagcgaataacaagtataagaaatcttttcctgggaaagaacaaaatccagagcataacaaaaacaaatcaagaaaaaaagttaaaaataaatcaaaaaaagagagaaataaaggagcaaggcgcaaataagcgcctttttatgctatgattatgaaaacgggaacaaaattggttgccagaggagggattatgtgaaagaacgtcaagaagagatcttgcatctattgacagaaaaccaacaaggattgacagcaagtgatgtagctgagcgcttgaatattgatcgaagcaatgcaagccgatatttaagcgaactgtataaggctcatcatattgtaaaaaccgctggccgaccagtcgtttactccttgccaacggaaaaatcaaaatctgatgaagtacatgtcgactcttctacgcaagtgacttttgaaacgctcgttggagaaaatgattctttaaaagtcagcatacagcaggcaaaagcagcgattctttatccgccgcgggggctacataccattatttttggagaaactggtacagggaagtcgatgtttgcggaatgtatgtatcattttgcaatcgaatctgaaatgctttcagccgatgcgccatttgtttctttcaattgtgcggattatgctcaaaatccccaactgctctttggacacatctttgggatcaaaaaaggggcttacacaggagcagcgcaagacagtcctggtctaatcgccaaagcagacggcggtatattgtttttagatgagatccaccgtttaccaccggaagggcaggaaatgctgtttactttcatcgataaaggtatctatcgtccacttggagaaagtgcacaagtacatgaagcatcagttcagatcattggggcaacgactgaatcttcagaaagcttcttgactaccttcaaccgacggatccctatggctatcaccttgccaaaccttgcttcgcgttcattggatgagcgttatgagatcatctctctttttatcaaacaagaagcgaaccgtttgaatcaacgtatcgatatcgaaaaagaagcgattcttgccttcatgctttatgatgcggaagggaatatcggtcaagtgaaacgagacctgaaattagtctgtgcaaaatcttttttacattaccgaacgcatcatgagaaaaagctgattattcgaaaagaagaactttcccttcaagtacaaaaaggactactgaaaatcaaggaaataccagaacgcctcgaccgattcatggacagtaagagccagtatttgacatttgaaccagggtttgctgatgtcgtctggtcacaagatccagaaagaaacatgcaagtctacaacgatattgaggaaaaagttacttctctttctgaaaccggtgtggagaacatcgatttggagatgctcatttcaaaagatgtggatgcttattttcagacatatgtcaaagaattgactaaaagttcaatcccaaaagatcttttgccagatgaaatctggcggttaaccaatcaattgtatgatgtggctgaaaaacggttagaccgtatttataatgaaaaagctcgttttgcttttgctttgcatttgcaaagtacattggatcgtgtgagagaaggacatatgattgtccatccagatttgaataatgtacgaaaaaattttaagagggaattccaggtagcaatcgatctttcgacaatcatcgaagaagaagaacaagtcgagattccttttgatgaaattggctttatcagtatgtttctttctatcaatttaggagaaagtgagcccgttaaagaaaacaaagtagatgttcttgtactaatgcacggcagacagaccgcttcaagtatgttggagatggcgcaagaactattaggaacaaaagtagggaaagcttttaatatgccactggttatggaagttcaaacaatgtatgaagaggtactacaatatgtcaaaaattatcaggggcatttgacgaatggcttgcttttgttaacagatatgggatcattaaacaccttcagtgatttgatttatgaagagactggcattcggacgaaagctatcacaatgacaagtacgatgattgtgatagaagcgatacggatggcaagtgttggaagaagcttagaagacgtctatcaaaatattcagctctcctttgaatcaatcgtacgtgatcagttcaaagcggaaaaatctgaaactttacagcgtaaaaaagccgtcatcgtgacatgctttactggtgagggagtagctgccaaattgtatcaacggattatgccggtgattaatcaagacaaagtagaactgatccagatgcagtttttagaacgcgaatcattcaaaaaacacattgatgccttattggaagaatacgagatcaaagcaattgcaggaacggttgacgttgattatcaaaatatcccatttttttccgcctatgacgtttttgatgatgaaaaattgaatgttttaaagcgtatagctgatgatgagattccaacagctaaaattgttgattcgctttcaggatcattaagtgatgtcttttctattgatgaattgatccgctcattgcaaaaaacagttcagcagatccagacagatttgtcgattatcgtagaaccaggagtagatactggaattgtcatccatttagccttcatgctagacggattgatcaaaaaagaaacgcatcggcaatttgagaaactatctattttctcaaaaatttaccgtttggaaatggatatcattcgagcaaacttgatggcactggaacggaaatatcaggtaaaaatttcagaagatgatatcgcgtttcttacacaaatgtttcttgaaaacaaaataaaaaaataaacacactaatcatactgtttacacactggatatcagtgtgcgcactatataaaagagctaaaaagcatgaaaacgctattttagctctttttttcttggcatgcttcttgcattatataaaagtgtaaaaaaaataaaaggagtgttaaaaatggcaaaaaaaacaattatgttagtttgttcagcagggatgagtacgagtttattggtcacaaaaatgcaaaaagcagcggaagaaaaaggaatggaagctgatatttttgctgtttctgcctcagatgcagataataatttagaatctaagaatgtcgatgttttattattaggtcctcaagtacgtttcatgaaagctcaattcgaacaaaaacttgcgcctaaaggtattccgttagatgtcatcaatatgcaagactatggcatgatgaatggagaaaaagtacttgcacaagcagaaaatctaatgaaataaatcaagtatgcagttgggggataacaacgtggaagatcaacaaaatctagaagccatcatgggactcatcatgtttggcggtaatgcaaagagcgacgcaatggaagcgattgcggctgctaaaatcggtgatttcgagttagcggatagaaaaatcgctgatgcagaagaatcacttatacaagcacatcatgcacaaacagacatgttgacacaagaagcacaaggaaatcatatgcaagtgacgttattgactgttcatagtcaagatcatttaatgacgtctattgcgtttactgatttagcaaaagaaatcatcgaactttatcgtcgcgtatacagcgaataaatacaacttcttttttgaacggaagaagaaaaatttttgaacggattttttattttgttataaagagaactctctttatataaaaaacttataggaggaagtaaaaaatgaacggactaacaagttggatggagaaatacatcctgccggttgccgcaaaaatcggagcgcaaaaacatttagttgctttgcgtgatgcttttatcggcacactgcccgcaacaatggcgggatcagtcgctgtaatgatcaatgcaattattcgagatttaccgcaacagtttaacagtacctacgctgacagtttagcagcagacaaaggaatctttgccgtattgaatgtcatcatcggaatcaatggttttgtctggaacggtacactagcaatcgccggattgatttttgccttttcttgggggtataatcttgcccgagcttatggagtaaatgatctagctggggggatcgttggtctagctaccttgattcaaggtatttcctttggtccagcattatcagcagcattagatgtgaatgtcccttcaaatgtcgcagatgcaatcaatagttctgagattggtgcaacgattgcagatggcacactgtcagttggattatggggttggctgaaactagatcatttgaatggaaacgcttattttacagttatgatcatgggggcaatttcagtcattattttttgtaaattgatgcttgctaacattacgatcaaaatgcctgattcagtaccaccagcagtatctaaagcatttgcagccattttaccagcgacgatcgctttatacgtcattgctattatcaattatatcgtaggtcgtgtagctgatgggcaactaatcattgatttggtacaaaaatatattgcagaaccattcctaggattatcccaagggttgggagcagtattgatcgtcacagtgtttgttcaagtattctggttctttggtattcatggaccaaatgtattggcaccagtgctagagggaatctggggacaagcacaactaatcaatattgatattttccaaaaaggttataacggaaaaactggtacaccagccgtgttagacgcaatcgaagatggaaaagcttatatgtgggtccgtggatcgttcgatgcttttgcatggtttggcggatcaggtggaacgatcgtcttactgatagctatcttgattttctctaaacgagcggattatttaacagtagctaaattatccattggacctggtattttcaatatcaacgagccagtgatgtttggtctgccgatcgtattgaatgccatcatgttcatcccattcttgattgctccagtagttgcgacagctatcggttggttagcaacttactttggacttgtagcaccagtttcgcaacaagttacatgggtagtaccgccgttcttattgtcattcttagcaacaggagcggattggcgagcaccaatcgtaacgttggtatgtatggtcgtgactttcttgatttgggcaccgtttgtcatttctgcaaacaaaatggaccctgccgcaggcgaacaacaataagatgaatctgaggagcgggacgctttaagtttcgttcctcataatgaattttcgaggaggaactgaaatgatttcaattgccagtgcaatgcaacaagatgcaatcaaagaattattagaaggatacaatgaagaaggaatgacatttacgtttaaagaaaaacaaggaatcaaaatgttctttgaaacaagtgcagaagatccggaagctgcggctaaaaaagcaaaggaactaatcaaagcacagccttggggaacagtcctttattttcagtcaacagctgtttaagaaaatggttcaaaaagataggatggttgatatgataaaaaacggtttatttttatgtagtattggttctttgatcgtgttgtatagtttgaatccacattcgcaaaggtatgatttgtatagtatggtcacgggtcttttcctaacaggattaggaatctacttcttcatgaaggggaaaaaaagagaagaagcaaaggagaaaaataactaatggaaatcacaaaaaaattaaatattccagcgtcgtttttttacgataaagttatggattctgttcttttcgatgtacgtaaagcgaccggcaaatcagtgaccagaaaacagctgaaaaatttggagtacgtcaaacaattctcgcaaaataaccgggctcgtataaaaatcgaagaagtcattgaaaaccagtcttataagtttcgtacatcgacaacgaagaatgaattcgttgttcattatcaaatcaaaccagtagacgattcgacctgtgaggttcattacacagaaaaaatggagtcttatggcatgcttcaaaagttgaatgatatgcttttaggaacgatcttgatgtactttaagcggagacgtttcaaaaaaatgctagagatgatcgaagcaacgtattaaaccagtaaaaaaatggtactatttagttattgaaaaatgaagtaagctagaagagatttttcagaggaagcgaggtctttcctgagattcctcactagcttttttgtaggaaggggcagcaaaatgacaaaacaagtaagagagctagggggatcttcgattgaggaaatgtttgctttagccacatatgcatttaatggggcagatacacctgaaaggagagaacgttttcgtacacttgcggagaattcctggaattacggtttttttgatgaggaggatcggctaacaagtcaagtcatggcgactccttttccagtgaatttttacggacaagagtatttaatggccggtattggctatgttgcttcttatcctgaagcaaggggacaaggcggaatcaatcagatcatggaaaagatccttgaagattgccgtgatcgtaaagtaagcttatcttatctggcgccattctcctatcccttctatcggcgctatggctatgaacaatcgtttgataaaatcagttatcaactaaacagtcgtgacgtgccgtttaccaaaaaaaaatctggcaagatgaagcgtatgaatttcgaagatgcaaaagctgcaatcaaacgaatttatgaacagatgcctgaaaaccaacgagctggtctgaagcgcgaagactggtggtatacgtataaattcaagcaaaaaggtaattaccagtttgctttgtattttgatgagactggggaagcaacgggctatgtcgtttaccagcttgcagcgtcttcctttattattgtggaatggggatttttgaatcatgatgccttttgcagccttgtccgctttgtaagttcccataacggtgcttttgaaacatttgaatattcatgtggctacggtggcaatgatcaaaattatctattagcaaatccatttgcttctgtaacgatcacaccttatatgatggcgaggatcgtagatatttctttgtttttggaaaaatatccatttagaaagaaacaagctgcctttgcccttcagatagaagaagatcagtatgcaaaatggaatgaaggaatcgtggaagtaacgatcaaaaatggaaaaaaccatctctcaaaagtagaacaaacagcattaccgatcgttcgcggaagtatccaacatatcacacagctattattaggatatcgtaaagttgaagagctggtattccaagagaggatacaggtggcaaaagaatatgaagaaacgttaagctcgatcttgccacagcaacagccaatccttaatgactatttttgataaaaaaagggtgatgacaatatttttgtcaccacccttttgttttttcgtttggcatttgaaggaaaatgttaaagtaaatcctcttttttcgtaaatttgaattttttgttttcttttgttttagggttttcttttttgtggtcttggattgcttctttcgtaatcttttcccgattttttttagatgaatctaagcgttcggcatatactttttcttttggcttatcattcattggaaagaacctccctgtattatttcattctactcctagtttatcatctgttaagagctagtggaaacgatttgcctaacttacaagctgatttttttagcagataagcttgcaagtaaaaaacaaacaagctacaattgatttattgaaattgttcctgtagctcagtaggatagagcaatcgcctcctaagcgataggtcgctggttcaattccagtcaggaacgtacaaataacccctgtatcctttgtgatacaggtttttttattttaaaacaacgaaaattaaatattttataattaaaaaaacttcattttttattgatataagggtataatttttattgaaggaaggtgataaaaaaacattttcattaaaacggaaagtaaaaaataaaaataaaaatgaaagagggagaaaaattaaaaaaatggattcttagcgctacattgattattttacttagggctttcgcagatgtaagggtaatagaacaaagtggttttactggtaggcgcgtagcttttccaatgctatgaagctagagcctttctagtgggcataagtatgtttgacttcttatgctaatctggacacataatgtacaggcgcactacatagagaatcacgaaagtgggatagtactaagtatagttgatacaaacagcacttcacagctagaataattggaaagtcagaagttttttgttcgatttgaaatacctagttagtttgaatacgtacataaagaatcttcttatttagcacttaataaaaaatataaaaaacatttaaaagagaaatcaaaggttttctcaatctttgataaaaaaggatgaagtagaaaatgaaaaaagcaaaattgatacttagcacaatcgtcttgacatctttaagtagtgggtttttagggagtgggacggtggatgccagtgcatataataataaagttgtttcgcttcgagctgctagtgacacaacgcttactgtgtcacgcataccttataatcctattctatattttgaaattggaatggaaaattataatcaatctgactcaacccaacgttgggtaatggagtacaatgcaaatgccggtggttattatatccgggagcagattccgggaggtatgaattctagtccgaattatatttggagggatagcaggggaggaggctttgtggacttctcgagtaacagagagaatgtagggactctgtggaagttacattcagccggacagaactcgttgggaaatatattttttatagaaaatatgtcaagcgggacctatttgaattggagcagaggaggtcatactgatctgggggtgttttctactgcatttgattggaatcgtgagcaaagattcattgtgcaagttgaaggagaagtttaaaagataaaatggaagtacactaatacattcaatctttttgacttatatctagagagtggggcaataatcagatttttttctgactattgtcccactctcttttttatatgttttttttattttatttgtgctaacaagattttgctcaagcccaatctccattacggaaaatcggtactgtagaaccgtcttcgcggattccatcgatatccatcttgtcagatcctaccatgaaatctacgtgggtttgacttctattcaaaccagcttctgctaattcctcgtcggacatttctgtaccgcctttcacactgaaggcataagcagaccctaaggctaaatggttcgatgcgttttcatcaaataatgtattgaagaaaatgataccagattgagaaataggggaagggtcgggaacaagtgccacttctcctagacgacgcgcaccttcatcggtatcaagcaattttgctaagacatcttcgccttgttcggcagaaaagtcaactacttttccatctttgaaagtaaatttcataccagagatgatcgtaccagcataacttagcggttttgtgcttgaaatatacccatctactcgatgactgtcaggtgcggtgaacacttcttctgttggcatatttgccatgaatttttttcctcgagcattgtagcttccagcaccttcccaaagatggtttttaggcaatccaatgatgatatccgtaccaggagcagtgtagtgcagggcagaaaattgttcttgattcaattcttctgctttttttgctaatttctcatcgtgttttttccatgctaaaacagggtcttcttcgtagacacgagttgttttgaaaatttgatcccataatgcatcaacttgttcttcttctggcagatctggaaaaacttttgctgcccattgtttaccagcagcagctacaacagtccaactgactttatttgcctgagttgccttgcgcaaattcattagtgctttaccggcagctgcttgataagatgctactcgttggctgtctacaccggcaaacgcatcagggtcggcagaaacgacactgatcctgcttgctcctttttcaagccattcatccgcttgatcgattttagattgtggcacattctcaatacgatctgttgctgcatgtaaaagaaattctctttgaatctgatcatccgtccattgaacgatgacttcagcagctcctaatttgtaagcttcttgtgtgatcaagcgagcaaggggtgcttggtccacactgatctgtaaaacgactgtgtgacctttttctgtggccacgccagtttctgcaattaagcgtgcatatttttttagaagttcattaaaatcggataacataataaaaattcctcctcaccattttttctggtaactattagcatgataccatttaatcatgattcaaacaatgtagctttaaataaaaaaaggaggttatttttttatggttgcgtttcacattctatgacacgacttgctattttagcttgtgaagaaaatcgaaaactaattttgcatatcaaaaaaaacatgttacaataaaattaatcaatggtggaagcgttataaaaaaattgaggagattaaaaaaatatggcaagaaaaaagacgattactaaagaacagattttggcagctgcttatgaagtagctgccaccgagggatttacacgatttactgcgagaaacatcgcgaacaaaatgaattgttccacgcagccgatctatcttgagttcaagaatatggatgatttgagacaagcactttttgaacaaatctatgattatttgcaatatgaagtgtttccagttgagcatacagggaatacgattatcgatcttgcttttaattatatccattttgcaagaagagagaagaagttgtatcgttcactgtacttagaagaatatggtggaggaaaagagatgcaaaatttctcttatacttactttgtgaatacagtgaaacgggacccaacctatgcggatctttcagaagagcagatcgaatccttgcataacggtacatggatcatagctaccgggattgcagctttgatgtcttcaagcattatccatccaactgatgagcagattgaaaaaatgattcaagacagcattgatgcaatcttgaatctcaaagaaccaatcgaaatcgattgaatatactcaagagtttcacaaatcagtagataacaagagatgtgtcaacataaggaaaatttcgtttttcttacagcgtatacatttttaactcccgaagaactcttccataaatacaataaaagagccgtctagattgattcaatctggacggctcttttatatctcaagcatattaaagttttgcgactaattctttagcgaaagcttctagattctcgatatcttcttcctcagcatttaagtctacttttacattttctgcgccttttgatgcacctgtttttccaaaagcagcatcgaagtcatccactgatttacagaattcatcgtaaaaagtatcaccagatccgcagacgccgtagatttttcctgatagatccaactcttgcaagtcttcataaaaatctacaatctcatcaggaagatcgccatcatcgtatgtataagtagctacgacgcaaatatctgcctcctcgaattcatctgcatctacttgggtacattcgttgatttcgacttcgatatccatattttcaaatgcttctgcaacaatatcggcgatttcttcagtatttcctgtcatgctagcatatacgatttttgctaaagccatgatgtgcctccttgtttaaaattatttaacaattatgaattataccaaaacatcgttgaaaagaaaataaaacctagagacacatgggaaatgtcatttggctaaatgtatgccgctatgttaaaatgagagagatttgtaaaaaggagacgaaaatatgattactttaaaatcagcacgtgaaattgaaatgatggcagaatctggcgctttattggcagatgtacataaaaatctgcgtgattttatcaaaccaggcataacaagttgggatattgaggtatttgtcagaaactatatcgagagtcatggaggaatcgctgcgcaaattggcttcgaagggtatgaatatgcgacttgtatcagtatcaatgacgaaatttgtcatggatttcctcggaaaaaacctttgaaaagcggcgatttggtaaaagtcgatatgtgtatcgatttgaaaggcggcatttccgattcttgttgggcttatgtagtgggagaatctacacctgagatcgaccgattgatggaagtaacgaagaaagcattgtacatcggtattgagcaagcacaagtaggaaatcgaatcggcgacatcggtcatgcgatccaaacgtatgtagaaggtgaaaatctagcaatcgtccgtgattttattggtcatggcgttggtcctacgatccatgaagaaccagccgttcctcattacggagaagctggaaaaggtttgcgattgaaagaaggtatggtcatcacgatcgagcctatggtcaataccggaacttggaaaatgaaaatggatcctaatggctggactgcttatacaagagacggcggactatcttgccaatatgaacatacattggctattactaaagatggccctagaatcttgacatcacaaggagaagaaggtacctattgatccagccaatcaataggtacgggagaggtacatgaaagtttggaacaaaataaaacaaaatgaaaatctgatgcgctttatcgagatgactcaaaagcgcattactgattcagaaatgagtacgacctcggttgtcgttgcttattatttactcttgtctttatttccattgattattgcttttggtaatattttgccgtttctccacatcgatcaagagactgtactgacctatttacgagaagtgattcctgagaccgtttaccagtttattggtcctgcaatcaaggaccttttgacacaaagttcaggcggtttgttatccgtttctgctttggcggccttgtggtctgccagtcaaagtatcaacgctttacaaattgcgatgaataaagcgtatggcgtagaaaatagaaaaaattttttgatcgttcgcttcttctcgctgatcgtaatcgtcttgttcatgattgccattagtggagtaactatcgttcttggtttaggacagctgattttagatgcgattcaaccgattgtacaaatacctgtgaactttattgatcagttccaaacgttgaaatggccaatcacattggtggctttatttgtcatcatgttcttgatttatttaattgtccctaatgctcaattgaagttgaagacgattattccaggtacgatcttcgctactgtcggctggatgctgttatcacaagtgtttagtatctatgccagatattttgcaacgaggatcagcggttatcagatcataggaagttttattgtcctcatgctttggcttaattttgctgctacgatcatcattttgggcggaatcatcaatgcagttgttcaagaatacgtgacgggacatcaaatcaaaaaacgtcgagatccaagccgaaaatggttcaataaattgaaagctaaattttctcataaaaaaaagtagaaacaagagttcttattgtaaatttatatcagtaatttataataattgtgactcttaattaaagtaggtgcccatatgcttgtttcttttagtatggttataagattttttctgacaattttattatcactgatattaacacctgtatttaaaatcatttcagtacaaacgggtatggtcgacaaaccaaatgaaagaaggataaacaaagttccaatgccttccgcaggcggactgcccatttttatttcatttgttatatcgactttattcttattccgtaaaatcattccacaatcgtatattgtgcccatcttgctcgcttctttggtgatcatcgttacaggagtactcgatgacaaatttgagctgacgcctaaacaaaagagtgtagggatcttgcttgcctctcttattatttattttgtagcagatatacgtattgattcctttacgcttccttttattggctatatccaattaggatggcttagtttccctgtaacgattttttggatcttcggtatcacgaacgcaatcaatctgattgacggtttagatgggctagcggcagggatttcattgattggtttaatcacgataggaatcattgggtattttttccttcatgcttccacagtgtacatcccggtcgttattttctgtcttgtagcaagcattatcggatttttcccgtacaatttttatccggcaaagatttatttaggcgatacaggagcgttattcttagggttcatgatggccgtcctttcactacaagggctgaagaacgtaacttttgtttcgtcaatttctctactgatcgtcatgggcgttccggtaacagatacgttttttgctatcattagaagaaaagcaaaccgtgtttctttttctacagcagataaaaaacatcttcatcaccgactaatcagtttaggatttactcataaaggtgccgtcctgacgatttatgcgatggctttgatgttttctttcacagctatggtcatgaattatactggaagaatcggaacgattgtattgattattgctatgctatttgctgcaattttattatttgaattgattggtctgattaacgagaaacatcagttcattttaaaaacattgcgatttttagggaataaagagtatcgtacgcaagtaaaacagaaatatttgaagaaatggaaccgtcatatagatgaataacaaattaaaccagccaattcttattagtattgtaacggcgaacagtgataagatttttcggacactagataattttatttcaactgtaaaagatgaaacagcgataaaaattcggatttttgacaacaactcccttccggaatataaaagcagactaaaagaatatgtgacatatccgtatatcgaaatctattttcatgatgaaaattccggatttggttatggacataatcacaatctgctgaacagcgattgccactatggcattatttgtaatccagatattttagtggatgaagaaacagttacagcattggtgttgttactgaaagaacatcccgaatgcgcgatgttagcacctaagattcttaatgaagatgggaccactcagcacctcatccgtgagcggctggctgtttttgattatgttttgcgctttgtgcctttcaaatgggtcaaaaaaaggtttgataaacggctggctgtctttgaatgccgtggcttgcccactgatgttgatagttatgtgcgaatgatctcgggcagttttatggtagctgatattgataaatttaaagagataaggggatttgatgagcgtttcttcatgtactttgaagataatgacttgtgtttgagttttgaaaaagcaggttacaaattattgtacacacccttttatgcagtcgtccatttttatggaaagggtgcacatcgaaatgcaaaactttttcgtgtgtttttgacttctatgatgaaatttttcaataagtgggggtggcgttttttctgatgaaaccagaaatagtagtagtagtcgtgctctatcagcaactattcagccaatctccaacttatggaccattaagcaaagcacttagcgaaaagcatattcagcttattatttacgataatagtcctcaaagacagcaaaatgagctgtttgaaaaagaaaacaccatttactatcatgatccgcaaaaccctggattagcggcggcttataattatgcgttgtctcaagcaaatgaaagaacacgttgtatcgttacattggatcaggatacgaggctagtcgacgactattttgaaatcttgcgtaaagtagcttttacagatgaatgtgttgctgcagttccgatgattttttctgggggacggcaagtttctcccgtctattcgaatcattatatcaatcgtacagcacatgcagtagaagtagacggtacgacagctgaaagaatcatggcaatcaattcaggtgtggcatggtctgtcaaatttctaaaaaagattggcgggtttaatcctgctttttctttagattttttggaccattggctgttttggaaagtgaatcagttggaaaaaacggtggagatactaccagtacgactggaacatgatctttcggtattagactatgaaaaagtttcaagcaatagataccgttctattttacaagcagaaaatcgattttatcatgaatatgatcaaagacatttatccagtcaccgacaacaattattgttaagaacagttaaacagtttttgaccgtcaaaaaccggcatatctggcggatgactttgcgctcatatgttaagaattggaaggtgtgaattcgtgcgttcggtttgtatagctacctttaatgggggcagatatttaagagagcagttggatagtattttatctcagctttcagcagaagatgaagtgatcatttctgatgatgggtcagtagatgatacatgggatatattgactgaatacgcagaaaaagatagacggataaagcttttttcaggacctcgtcaagggttgatcgctaattttggctatgcgatccagcagacgaaaggagagctaatctttttggcagatcaagatgatgtttggttagagacaaaagtgaaaaaaatcactgactattttgaacagcatccggatcaattagtagtcgtttcagatttgatcattgtgaacagtaagctgcaagagatccatgcttcctatttttcattccgaaattccaaagaaggatgggtcaataatgtgatacgaagtcattatattggtgcaggtatggcttttcgctcttcgttgaaatccgatattttgccgattccgtcagaagtgcctatgcatgacatgtggatcggtttgttgggaggaaggaagactgggtttctgagagaacctttgacactgtatcgaagacatgatttaaatgcgagtgagattgaaacgcattctaaattacgccaaaaaatttcctggcgtgttcatctgattacggcgttgatcaaacgaaaatggtttaaacgttgataaaagatgtttaaatccttaatatttccatgacaaatacaacgattgatgagataatagcaaagtgaaatttgaaatcaaaaaggagagcatatatccatgaagggaatcattcttgctgggggcagcggaacacgtctgtaccctttaacaaaggcaacatcgaaacaattgatgccgatttatgacaaaccaatgatttattatccaatgtctactctgatgttggcgggaatcaaagaaattctgattatttcaacgccacaagatacaccacgtttcaaggaattatttggaaacggaaatgatttaggactgcagatcgaatatgcagtacaagaaagtccagatggattggcacaagcgtttatcattggagaagaatttattggagatgatagtgtctgcttggtattaggggacaatatttactatggtggcggtctgtctaaaatgttgcaacgagcagcttcaaaagatgcaggcgcgacagtatttggctatcatgtcaatgatccagaacgctttggtgtagtagaatttgatgagaatatgcaagctttgtcgattgaagaaaagcctgctcagccaaaatcaaattacgcagtaactggcctttatttttatgacaatgaggtgatttctattgctaaaggaatcaaaccgtcagaacgtggagaactagaaatcacagatgtcaataaagcatatttggataaaggaaaattatctgtagaacttatgggacgcggatttgcttggcttgatacaggaacacatgaatcattgcttgaagcatctacctttatcgaaacgattgaaaaacgtcagaatttaaaagtggcttgtttggaagaaattgcttaccgtatgggctacattgataaagaacaactgctagcccttgcacagcctttgaaaaaaaatcaatacggtcaatatttattgaatttggccgctgaataaggagttcctacagatgaaagtaacagatacaaaattaacagatgtaaaaatcgtggaaatggatgtctttggcgaccatcgcggtttttttacagaaagctattcaaaagcaaaatttgcagaacatggattagattatgactttgttcaagacaatcattcgttatctgctgaagctggtgttcttcgcgggcttcatttccaaaaaggagaagctgcacagacaaaattgattcgtgtggttactggagcagttttagacgtagtagtggacatccgcaaaggcagcccgacttatggtcaatgggacggatttatcttatctgaacataatcatcgtcagttgcttgtacctaaaggatatgcacatggattcgttactttgacaccaaacgtgaacttcctttacaagtgtgataattactataatgcagaagcagatggaggcatcgcatttgatgatccagatttagcgattgattggccaattgatccatcaagagcgattatgtcggaaaaagatcaccgtcatccgacattgaaagaatttgaagcagaaaatccatttgtttacggagaaatctaagaattaaggagaaattttcttatgaaaaacatcattgttaccggaggtgccggattcatcggctctaatttcgttcattacgtggtaaacaatcatccagaagtgcatgtcactgttttggataaactgacttatgcaggaaacaaagagaacttggctggacttcctagcgatcgcgtagaattggtcgtaggagatgttgcagatgcagaattagtggaccgcctagtaaaagaagcggacgcagttgttcattacgcggcagaatcccataacgataattcattaaaagatcctttcccatttgtacaaacgaatatcattggtacgtatacacttttagaagcttgccgcaagtatgatgtacgctatcatcacgtatctactgacgaggtttacggcgatcttccattacgtgaagacctaccgggacatggagaaggcgaaggagaaaaattcactgccgaaacaccatataatccttcaagcccatattcttctacaaaagctggttcagatctgttagtaaaagcgtgggtacgctcttttggcttacgtgcaactatttcaaattgttcaaacaactatggtccttaccagcatattgaaaaatttatacctcgccaagtaacgaatattttaagcggtattcgtccaaaattatatggtgaagggaaaaatgttcgtgactggatccatacaaatgatcattcttcagcagtgtggttgattttgacaaaaggcagaattggcgaaacctatctgatcggtgcggacggcgaagaagataataagactgtgatggaattgatcttagaaatgatgggtcaaccaaaagacgcatacgaccatgtaaacgaccgtgcagggcacgatttgcgttatgcaatcgattcgacaaaattgcgagaagagctaggttggcagcctgagtttacgaacttccgtgatgggttggctgacacgatcaaatggtacgaagaacatgaagactggtggaaaaaagaaaaagaggccgttgaagcagcatatgccaaaaatggacaataatacagagaaaatttcactgtattaatggaaaaacacatgtgaggcaggcgctcgcctgtctcttttttaaaataaaaatcaaggagcggataaccatatgtttttattaactggaggaaatggacaattaggtacagaattgcgccatttattagatgaaaaaaatctgccatatgtttcaacagatgcaaaagacttggatatcacagatgctgagaaaacaatggcttatattacagaattaaaaccggatgttattttccattgcgcagcttacacagcagtagataaagcagaagaagaagcaaaagaattagatgagaaaatcaatgtcgatggcacaagaaatgtagcgcttgcagcaaaagctgtgaatgctcaattcgtctatatcagcacagactatgtcttcgatggaaaaaacaaaaatgtagagtacgaagtagatgaccaaacgaatccactaaatgaatatggtcgtacgaaattattaggtgaaaaagcagtagaagagattttagaagactattatatcatacgaacttcttgggttttcgggatttatggacacaatttcgtcttcacgatgcaacgcctagcggaaacccgcgacaaactgactgtagtaaatgaccagttcgggcgaccaacttggacacgtactttggcagaatttatggtatatgttatcgaagaaaaagcaccattcggtatttatcatttgtcgaacgaaaatagctgttcttggtatgaatttgccaaagaaatattgaaagatacagatgtggaagtagcgcctgttacatcggaagaatttccacaaaaagcaacacgtccgcagtattcagtcatgagcctgaaaaagacagaagcgttaggatttgccataccaacttggcaagaagcacttgcgcaaatgctggaagctgccaaaaaaatgaataagtaatttcctttttatcaaatagaatttggagcatgatatggaaaaacaaacaagaagtgcacgacgaaaagaaaaaccaaaagcgaatcaggcagattcgaatttggtgcttgacctgtttctaaaactccgataccttattggtgttttagtcatcgtggtcattgttacttttaatttaaacggaagttcacttggtgtttgggataaatatgtgtcgcaaagagacgatgggaaaaaaactgatgtgatttttggacagaatcgggaagtgcggtcagatgaatggctggtgcagacacctttttacctctcacaagctgaagaggactttccgttggtgaacgaagattattcattgaacggacaaaacatgatcattgcgtataattctcctgtaaaggatattacggttatcggaaaaccattcaactggggattcttttttctcggaagagatcgaggcctttccttttattgggcgatgaaattagtcgtcatggtcttgcttggattcgaagtactgatgatattaacgaagagaaaaaaagcattatcgctgattggcgcatttgcgctgacattttctcccgcagtccagtggtggttcatgcagcatgtgggcgatttgattttctttactttgggattgatgactgctttttatcattatttctacaatcatgataaaaaatggctgcgaacgttgatgatgcttttggtggttattttcggtattgggtttattttagtgatttacccagcccatcaagtgatgctggcgtacttgctgattttttattttgttggcctgcttatttactacagcaagaaaatttcttgggatctgttggatgtagtgttgattggaggggcagttttatttattggcggagtcatggttcatttctggctgacgtcaaaagacgcattgttagcttctttgaataccttatatccaggaaaacgagtcagtaccggtggaaagtggacgattggcgaatttttttctttcctgacaaactggaaaattccttttgaagacatcaactattcgaataactctgaagtggctttgttctatcacttctttccaactgtattcctagccagtccatttgtgttatttggcaaaaaagatagtgaacaaaagttattgggacgtattttgatgattttttgtctgttttctatcttttggattaccgttggattgccaaaatggctagcagaaattactctgctgtcttatgttcctcctttaagagccatccttacttttagttttgcggcttgcctattatcaatttggttcatcgcttatatttggagagaagatgttattcctatttggtataaattcattttactggcagtaaacgcatggtcttatttctatgcaattactcattcgaagatggataattatttttcagatttcgaaaccatcgcagttgctgtgttgggaacagtgattttagcttttgcattatttggctggagacgcttgttttatcttgcttttgccgccgtgatcatcgcatctggtttctttgtcaatccagtcgtagaaggtactggagcgatttttgaaaaaacactggcaaaagaaatccgaaaaatcgatcaacaagaccctggcaaagtctggttgactgaagatgaactgtataatttcaccccaactttgggtgtgaaatctttcaatacagtccgcttttatccagatatggctgcatggaagaaaatcgatccaaaagaagaatatgagaagtattataatcggtatgctcacacaagagcttttatcgctaaggaagatacaaagttcattttagatcgtccagatatgttctcggtcacgttgaattttgaagacgcagaaaagttagggatcaactatgtaatcagtaagcgaccgttaactgattacaatcagttatatgaagctcaattcacacaactatatggaccggataaagatggttatatgatttttaaagtagaatatcccgattatccagttgtaccacaaacacaaactcaggaaaatcagctagtcttacagtaatgggctagctgagaataaccctgaagtattattagaaaggagagtggagataattcaagcaatcgtacaaaaatttgtcaacaaaatgagtgctggtttcttgcttttgctgctgacgctggtcttttctgtttggacagcaggattaagcttcccagccactttgtttatatataacaacagttcgctacttatcacttttagtgtggctattttgctcattttaaatgtttataaagcaaaaggcgtcgattttctttatttaggtgttgcgcttgcacttttcattttcttttcttactttcgggaattaagaaatgagtctttatttggagatttactgtttcctttgattattttattttgtttagtaattaaatggattgagtggacaaaatgggatcgcgggatttatctgcttgtctttacggtcttcctcggaatcacgttatatcgtgtatttacagagatccaagtaccagaaggacaaagcatctgggctccaggaaattcgctttctgatatttggatcaatacgaatacaatcggaagttctttgatgactcttgctttattgatcagcggatttgccagttcttttgaacggtggtatgttcgtatcatcggtgggatagcagtcgttgcagcctttttaggtatttgggtctgccaatcaagaggcgcattagttgcattgattgtttttgcgatattggatcttttacctaaatcattgatgcgtgtcattcgtgcaccgtttattgcctatacggctacgattcttttggctttgccgatttcttatctagccgctgtttccgaaaaagtcaatttgtttaccggtcgagaagatatttggcataaattctatcagacgctaggagaaaaatctgagcaagttttactagggatgaaaacattcatcttccaacgaggaaaccaatttttaggaaaccacaatagttataattctattttgaatatctatgggttaatagggtttggaattgctgctttgctgcttatcctttttattggtcgtttaacgttgaaagcagatttgtccaacgggcagatgacttttatctgggccttttttgcggtgatgatgcagtcatttatggaagatacattgacttcatacccatgggttccgattatttatatcctattggctatgtccgttcatcgctatgacgaaacgaaagttatggaagaatactatgacatagaagagccatatgacgacatgaatgctggagatccaagttatgaggaacaaccagatagcgctcattcttccaggatccaacgctatcattgataggcgcaaaatacgagagaggctgtgacaaccgtcacagccttttttgatttattgcaattgtctagcatcttctgtaaaatagaaacgttagagaaaatcttgtatcatagaaaattaagaaataaataagaacgcagctcggtaccaaaaatatggtaaaatggcacttgactgtaattcactgaaatcgcttggaggaacacaaatgtttaaagatttgtatttatttatgaaggacatttatcagaacagaaaattactgctacagttttcgatcaatgacttcaaatcaagatatgcaggatcgtttttagggatcttatgggcgtttatcaatccgttatttactgtattgatttattggctggtatttggcgttggattgaaagcacaaatgatcgatgcaaaatacccatttatcgtatatttagttaccgggatgattccttggttcttcttctctgatgcctttgcatcaactacggttgtttttcgggaatatacttatttagtaaagaaagtcgtattcaatattcgtatcttgcccacgacgaaaatcctatccaatttgtacacccatttatttttcattctgattggcatagctgttgcgcttataaatggtatatatccttcagccatgtctttacagctgatttactatctattttgcatgtgtgctttcttgacaggattgacttggctgacagcatccatccaaccatttttaccagacatcatgcaattgattacgatcgtcttgcagttgatcatgtggacgttgccgatattatggagcccgaaccagtttgactcaggtcttgtaagcatattgaaattaaatccgctgtactatgttgttcaaggctatcgtgagtcgtttttaagtgaagcttggttctgggagcatggaacatatactttgtatttctgggtgttcacattagtaatgttcgtaatcggctctgcagtgttccgtagattgaaaccacatttttcagatgtgctgtaaggagaatagctatgacagaatatgcaattagactaaaagatatcacaaaatcttataatatgtacgcaaaaccgtcggatcgatttcgtgaagctcttaatccttttaagaaatcctatcatgatgtgttttatgcgttgaaaaacgtgaatgtagaaataaaaaaaggtgagatgatcggtttcgttggagaaaacggatccggaaaatctacgatgttgaaaatcattacaggggtactgacaccaacatccggtacgatggaaatcgaagggaaaatctctgctttgctagaactaggttcaggatttaatcctgagtattctggctatgaaaatatctatttaaatgggatggtactaggcttttcaagagaagaagtcgatgaaatggtcgatgatatcattgaatttgctgacatcggcgaccatatttatcaacctgtaaaaacttattcaagtgggatgttcgttcgtctagcttttgctgtagcaatcaatgtgaatcctgatattttgattgtagatgaagcattggcagtaggagaccttgaatttcaactaaaatgtatggaaaaatttacagaaatcaagaactcgggaaagacgattttattcgtttctcatgatatcagttcgattcgccgtttttgtgatcgttcctattggttgaaaaacggagaagtcgtcgaatatggcgatacgatggaagtaacgacgaattatgaaaactttttaaagaaaaaatcagttaaaacagtggatcggaataaaaaccaagtagaacggttcgccgctccagatatcgtcgacgtgacgaaagcggaattgttggataaagacaaaaatccggtggatatgctggaacaaggagaaaaactatacgttaaagtaacttatgaagtaaaagatgatacaatcaaaaatccggttttaggaattgcgctacgaacagtcgacaatttttatgtgtgcggactcaatactctactagatggtatcaagattccttggaaaaaaggagagaatatcttttatctggagtatgaaaagttaggtttgttagctggtgaatattattttgacgttgcggtctttgaagaaaatgcaacggttcctttggtatataagacaaagtacatgaatttgtttgtcagcggttcttatatcggagaaggcatcgtggtcttagaccataaatgggaagaagggactcatagcaatgaaatatgattttgaaatggacctagatgaacaaagcagtgtgggaaaaattgccgcacagatcaaaccaggaagtaaagttttagagtttggtcccggaaacggccgattaacgaaacatttaatcggtgcaaaacaatgtgaagtgagcattgttgagttagataaggaattgttcgattttgtcagcgaatttgctcaagatggattttatggtgatatcgaaagttttgagtgggcaaactattatgctggacagacatttgattacgtcttgtttgcggatgttttagaacatttggtagatcctggaaaaacattgaagaaagtcagagaatttttgaatgaagaaggagagatcctgattacattccctaacttggcgcataattctgtcatgatcgatttgttcaataaccaattgccgtgggcttcttatggtctcctagatgaaacccataattctttttatactcatgatggcttccaaaaagtttttgaaaaagcgggattattcattaatattgaagattatttgtacttagctgtaggtgatacagaattaaaatcaacttatgaagaattgccggaagctgtacgctatgatttcaaaatgcgaccatttggtgaagtctaccaatactttttctcattgatgaaacatccagtagcacaaagttccattgcacagccacaaaactctaattatgtaaaagtgttagaagtaacccagcaaacgaaacaagatgaaacaatccaacaaataccattcaataatttcacaggggaaaatgagacactaagtttccccgtgtcagaagcaacagaaagaatggtgtttcgcttcgcacagcaacctagctttatcgaattcagcgcagaagctgctggagaaaaactcacatttatcgattcgaatgctgtagtcaaaacagtaaatgattgttatttgtttgatgggaaagaattaccagagttcgttctaacggatatttctgggaaagaagtgacgatccattgtcactatcgctttatcggggaattgacaccaacaatgaaagaattgttggaaacgattcgtcccatggctgaagtcacaaagcagctttctgagaaaaatgatgaattagaaagagaaaatcatcatcttcttgaggaaaatacaagactaaatcatatgttaaaaacaaccacaaatcgctattgcacattgttggaaagtgatgaatggacaatcaaacatagactaggacgacgtaagaaagaaacatcgaaaaaaatccaagaaaaagagctttctatatgtattgacgagaaaatctgggatgcagaaacaaaaatattaaaaatcatcggatggggaatcgctaattcggatcgccagccattgtcctataagttatcagctgaccaatcgccatttttcgaagcaattcctgtttcacgagaagaagtcaatcaagcagaacagctcgcaaaaggaacagaagcgggatttgaattacgaatcctttgcgagcaagaacgttcattcttagtggaagcagtggctcaaaatggccaatcatggatcattgaaatgtaaataatgattaacttataaagataaggagtaaacgaatcgtgcaaaaaaaagaaattgccgtatttatcgatcaaatcactcgtgaacgggccactggcgatttgcttattgtgggctgggcaattgatgaagtgaccaaagaaatccctacgataaaggtagaaaaagaaaatgtgattgctgaagcaacacatgtcgtaagattggatatcaatcatttatataatcttgatgttaagacccaaagcggttttaaggtacgtttatcagggaaaatgagaggaaaggcaatcttagacttccaaacagcgagacatcaaaatggcatagctgtgaaattaaacggtaaatacccttatgatgacggcattgaatcttcatgggaaagaaaaaaaagattactgaaaaaagggataaattatgcaaggactcatggcgtaaaaaaagcgatccgccgagtcaaactggaattgaagccaggatcgatcgactatgcagaatggatcagtcgtcatgagaaaccagatctgaaagagcaaaggaaagaaatacaaggatttgcgtaccgcccattgatttccatacttatgcctgtctataacgttgaaatcaaatggctcgaaaaatgcattgattcggtactggatcaaacatatgctcattgggaactatgtatcagtgatgatgcttccactgatccagctatccgaaagtgtctggaatcctatcaagcaaaagatgatagaatcaaagtcgttttccgacaagaaaatggacacatcagtctggcaactaattctgcattggaaatggcagaaggagagtttatagcactcttagataatgatgatgaattaccgccatttgcattatatgaagtggcaaaagtgctaaatgtacatccagaactggatttgatctacagtgacgaagataaaatcgatgcagacggcaatcgctttgatccgcacttcaaagcagactggtctcctgatacattgatgggaaataattatatctctcacttaggcgtatatcgaacaagcattgttaaagaacttggcggtttccgtaaaggctatgaaggttctcaagattatgatttggtccttcgtgtgacagaacaaatccctgcagatcatatttaccacattgaccgagtcttgtatcattggcggacgatcccaggatcaactgcaagtaatggtgaagccaaaagttatatctatgactccggagtgaaagcactgacagatgccctgtctagaaggaatatcaaaggaagcgtacgtcctggcagaatttctggattttatgagattacttatgacgtcttgcaagaggatttggtcagtgtgatcattccaacgaagaatggctatgaagatctaaaaacttgtgtagattcgatcatcgaaaaaacatcttattcaaattatgaaatcattattgcggataatggaagtacagatccaaaaatgcaagaattatttgcagaatacaagcatcagctgaaagaccgctttatcgtagaattgattgacattccattcaattattctcgaatcaacaatttagcagcaaaaaaagcaaacggcaaatactttttattcttgaataacgatacagaagtgattgagccagattggatgacggcgatggtttcttatgcacagtttgatcgaatcggctgtgtaggagcaaaattgttttatccagatgatacgacgcagcatgcaggagtattattaggaatcggtggtgttgcagggcatgcattgaataactatgatcgaacacattgtggttatttcggccgattagtcattgacgtcaattacttagcagtcactgcagcttgtatgatggtcaaggcagctgacttcaatgctgttaacgggtttgatgaaacattagaagtagcattcaacgatgttgacttgtgcttgaaagtttatgaactgggtcgttacaatgtctatgcacatcaagcggaattgtaccatttcgaatctaaatcaagaggttatgaagatacaccagaaaaacaaagacgttttgctggggaaatcaaaaaaatgcaagataagtggccttcttatattgctcatgacccattttataacgataatctaactaaagaaggaatcggcgatttttcgttgagacctgattgatcaaagaactgtattttcatttttattgatgaaaatacagttcttttaattcagaaatacacatacaagcatacaatagttgccttttctagtttcttttaatttcttttacaatttggttattcactaggtttttaaactttgctatggtaagatgatagaggcattattttatggttaggagtgtatatatgaataaaaatggggagtggaatgcggcacgcaggatattcattatcatcatggatgtacttgtattgaatgtgtcgatctatcttagctttttgctgaagttccaaggagaagtcccagcaagaaacttagagacctttcagcattcagcaatttttatttccattatctttattgcgttgaatattttgttaggagcttatgtattctataaccgaatgatcagtgatatcgtcttcattactgttattggacaggtgctgatagcattggggatcatggtggttacttttgctggacgttggtttgcatttccgcgtggcgtcatcgtgctctcgtttatacttggcacgatattacttagcgtttatcggatagtcgtttataaactatacttaagagtcagtcgtgataagaaagtacttatcgtaggtttggagaaagatgtcgcaccagcgatccaaaactttcaatctaagaaaaacaacaaacataaggttgaagcagtagtgatcgacaattattatgaaaacacaaaaaaattgattgatgacatcgatattgtctacttggcttcaaaaatcccagaagatgaaaaaatcaatatttatcaattagtgacaaaaaaagagaagaagctgtttttaaatacaacttttgaaaatttaacgatgatcaatccgaacatcatgaatttcgaagatgaaagtatcattgaagcttccggtttcaaaattcagccggaatatgaattattcaaacgtctctttgatatcatcgtttcgcttattttattgatcctcgcttcaccttttatgctaatcacagcgattttggtaaaaacaacttcacctggaccaattatttataaacaagtacgtattacgaaaaatcaaaaggaattttcaatctataaatttcgttccatgagtgcaacagctgaagcaaaatcaggaccagtcttggcaaaaagcaatgatgcacgtgtgacaccagtaggcaaatttatccgtgcagtacgttttgacgaattacctcaaatctttaatgtattgaaaggcgatatgtcgatcgtcggaccacgtccagaaagaccatttttcgttgatcagttcaatgaagaaaatccttattattatttaagacacaatgtacgtgcagggattaccggatatgcacaagtatacggaaaatatgtatcagattataatagtaaactacgttttgatttgttgtatatcaaaaagtattccttactattagatttaaagattttacttcaaacaatcaaaatcttatttgataagatgtcctcacaaggactagatgaagatgaaaatatcagttcattagcagaaatcgacttttcacaagagaaaatttatcgctaagctggaggaaagaaatgaaatgagccatccgatatttagtataattgttccagtttataatgccgaagacacgatctttcatactatagaagttttaaaaaatctggcatttgaagaatatgaagtgattttggtcaatgatgggtcaactgacaaaacagagcagctgattcagtcagctatccaaggagatagtcattttcaactttttacaactgaaaatcaaggacctggacttgctcgaaatgaaggcatcaagcaatctacagggaaatatgtattatttttcgatgcagacgatgagccagtcaaagaaattttggcagattatcagcagttatttgaacagtatcctgaagcagatctgcttatcagttcttttatattccgcacgctaagcggggaagaaatcatttcggaaaaggactatcttgttccagaataccaatatacaaatcatgaacagttcgtggatgatatgtatcatctgatgaatcagcagttgatgtatgtggtttggaacaaatgttacaagagggaaatcttgatggaaaaacagattctattcaaaaattacagcagttgtgaagaccgtatcttcaatttgaactattatgaacattgtcagcaagtaatattgaatccaagaatcgagtatatctatcattttgaaggtggaaaagggataaccaaccaatataaaccgaataaatttgaaacctttaaagaattttatgaattagcaaatgtcgtgacaagtgataaagacaaaccaggtatggcttctcttcttttaaaaggaacaacctctgtcattttttctatttatgagaatcctgagcggaatgctaaagaaaaaagagaagaagctatgcatatcttgaatgatccagccatccaagaagctaaaagggttgcattgactgattccagcgcgaaaaaagtaacaaaatggctgtataatttgccggctcctctattattatctgcggtgaaagccggcagctttgtggaagtgaaaatgccaagcatcatggcattgttgaagagagtttattaaaaaagtcggaataaggggttgtgactgtcttttgtcacaacccttttaaaaacaaaaaatagctgtttatctatcctttttcagtcagtaaagaaagaaccacttgcataagattgaaaaccgcctctatttatgagaaaatagggaagattaataaaagaatggttgaggcaactataatgtacagtacagatcctgaattaaaaaaaattcaaaaagtaaatctcgaaatggcacaatactttgtagatttttgtaaaagtcacgatttgttgtgttatttttgtggtggcggcgcaatcggagcaattcgacataaaggttttatcccatgggatgatgatttagattttttcatgcctagaagggattatgatcgcttagctgaattatgggaaaccggcccacaaaaagataaatttgttttattaagaccaactctgacgaatcacgatcggaactcctttacaactatccgtaacgtccaaacgacctttatcaaaacgtatcaggaagatttagatatccctcatggtatccaattagatatttttccgttagatactgcacctgaaaagcaagcagaacggaaaaagcaaaagatatgggcaatgatctatgcgctttatcgaagtcagcaagtaccgcaaaaccatgggaaagtaatggaattagctggaaagttattgttaaatagcgtatccgcaaaaacgaagtataaaatatggagatatgctgaaaagcagatgaccaaatacaatgataacccgacgaatttcgttacagaactttgtgtcggtccacgatatatgggaaatgtttatcctgcaaaagactttgaatctgctgtgtggataccattcgaagatacagagatgccagtaccaattggctatgatcattatttaagtcaagtttttggcgactatatgcagcttccccctgaaaaagatcaggtttctcaccatgaagcagtttatattgacccagaacattcatacaaaatgtacaaaggaaaatattatttaactaaaggagcagaaaaaaaatgattacagctattattattgccggcggtgtcggtaaacgtatgggacaagatatcccaaaacagttcattacaattgaaggtaaacctattattatctatacgttagaatcatttcaaaaacatccacaggtcgatcggattttagtcgtttgtaaatctggctgggaagaaacgatgtgggcgtatatcaaagaattcaatattagcaaagtccaatgggtcatcacagggggatcaaaaggacaagagtcaatcaataatggtgtccagtttttgaaagattactctgaagacgatgatacgatcatcatccatgatggtatccgtccactagtagacgaactggtattgtcagatgtaatcgttaaatgtaaagaatttggtaacggtgtaacctctctaccttacaacgaacaaatttttatcaagaaaacagaagaaacgacggaacagtatgtcgatcgtaacacattgcggcgtgtctcaactccacaagcttaccaatacggaaaactacgggcagcatatgaccgagcagtgaaagaagacattggtatgactgattcttcctatacgaataccatgatggtagatttaggagaaactttatattttgctgctggttctgataaaaatatcaaattgacaacaacagatgatctagaattgttcaaagcatatttaaaaatgaaagactaggagaaagatgatgacgttgattaaacaaccaatgtaccaaaaagatttggcaaaagtgatcaatcatacaccaaaaataaaacagctacatggcaaatccgttctgatgattggcgcttcgggaatgatcggttcttttttgattgatacgttgatggctgctaatgaagaactagacatcaaaatcaaagtatatgctatgggcagaaaccgtcagaagcttgaaaaaaggtttgccagttatcttgccttagatactttcgaaattgttgaaggtgacgtcacagagcccttaccaaaagaaattcaagctgactatttgatacacggtgcaagtaacacacatcctaaggcttacgcaactgatccaatcggtacgatcatgactaatcttgcaggtacagagcaagtattgaaacatgcagtagcaacccagcctgagagagtattatttttatcaacagtagaaatctatggcgaaaatcgaggcgatatagaaaaatttacagaagattactgcgggtatatcgattgtaatacactgagagcaggctaccctgaaggaaaaagagtcagtgaatcattatgccaagcctatatcgcaaaacacgacctcgacatcgtgattccaaggctttgccgtacgtttggtccgacgatgcttttatccgatacgaaagcatcctcacaatttattttaaatgcagtcgaacaaaagaatattgttttaaaaagtgaaggaaatcagtatttttcgtatgtttatgttggagatgctgtttctgctattcttcatttactgcttgaaggagaaaaaggagaggcgtacaatgtttcttcagaaaactttgatttacgactaaaagaattagcacaacagctagctgatatcagcggcaaacaagtaatttttgaattgccggatgagattgaacaaaaaggtttttcaaaagcaaacacagctattttagataatgaaaaaatcaaaatgacaggttggacaccactttttgaactaaaagactctttagtccataccgtagaattagttaaaggtgagaagcaaaatgtgtgagattagtattattgttcctgtttataaagtagaaccctatttaagaaaatgtgtagattcaatcttagcacaaacatttactgatttcgaagtgatattagtagatgacggttctcctgacaacagcggtaaaatatgtgatgaatatgcatcaaaagacagtcgtgtccgtgtcatccataaaaaaaacggtggattaagtagtgcaagaaatgccgggattgatgtggcacgagggaaatatttaggctttgttgacagtgatgattatatcgaaaaagatatgtatgaagttttgtacgacaacattgtcaaagaacaagcagatctttctatttgtggagtatatgacttatacgcaagtagggagcctaaaattttaatgccacaatatatggttttatcgaaaatagaagcgatgaaaatgattttagaagcaaaagttgtttctgttcaggcttggaataaactatacaaaaaagagatttttgatactatccgctatcctgaaggtgttatcacggaagatgctgctgttatcctatctgtattagaaaaaacagaaaaagtagttattgacactcagcagaagtattattattttcatcgggaaaacagcatttcaagtagtggttttggggagaaagatcttgatacaatcaatgtttggaaagagaatgaaatttggattaaagaacgctatccaaaattattaccagtggcacatactagaacttgttgggcacattttatcgttttagataagattgtgattagtaatagtgaatgtagctataaaggaaccaaagaaatagtaagatttttaagggataattatttgttcattttaaagaatcaatattttactagaaatagaaaaatagcggcgacagcattaaaaataaatttaaatttatataaaaagctttccatattggaagaagagaagcataaaagtaagcatagttaggtgagtggaaaatggatgtaaaaaaaataaaggttttttctgataaaagcaaaaaaatttttatagttgtctttggagtcgcattgaccattcggttaattaatttttatagtcttttgccttcaaaaatcgatacagcattattttcgttgataactgtatgggcctttgccattttaataattgatgcgttatctaaggacgtaaaaatttataaaacagattatcttttattaggatttatattagctattttgtgttctacgttctttaatggacctagtgggataattgaaaacattaaactagtcatttggcaggttatttatttatttgttgtttatcgtattggaagagatagtattgattctgaatttcttacaaaattcgaaaaattaattataggtatttggaatactttggttatcatttctttaggaatgttctttacgcactattcttacgtagcaccttttgataaattttataatggctttagagcaggatttgtcgaaaaccgtttgtatggtattttttctgatcctaattttgccggtgcaacttctgtagcagttatttttcttgctgtaaagctattaatgacgaataaaaacaaaatggcaaaaatttatagcatagttacgatccttcttcaatttgcttacatcattttgtctggatcaagaacagcagagattgctttggtattgtgtgcttattttgctatcttctttattgtttataaccgatttgggaagacgattgcttctaaattattattggcagtaatctgtggggttattggaactggagctgttttaggaattgctgaagcagggaaatatgctgcccctaaattgatcaatataacagcaagatatgttcctagaaagtctgaaaatccagataaagatcagaattctatcagtttaaaacgggatgatgttgtaaataaggacgatgtgtctaataatcgttttgctttatggaaaagttcgtttgagatttttcaaagtagtccgcttgtcgggagttcacctcgtaatttagttaattatgctcaaaaagaattaccgaatacgttcattgcaacaaaaaaacaaacttcccataattttattttctatttattagcaacaacagggctgttagggactataccgctacttgtatttcttggaattaagatttggaatacattgcgacaactatttatgcgtactataaaagactacgattcgtatgtattaaataccatggtagtacttgcaattttgatttctgctatgtttttaacagaattagtattagtaaataaattaggaagcctcatcttttggctatatttgggatatatatcaaaaaaacatcctgtggtaggtaagggaggtatatcagaataatgagagaattaaagattaaagatatccaacgtataagcgtagaaatccttgtttatatagaccaaatttgtagagaaaatcagattgagtattcattattttatggaagtttaattggttcagagcgacatcagggttatattccttgggatgatgatttggatattattttgaccagacctaattatgaacgattaatccaacttcttaaaaatgatgattcgtataaattattaagttttgaaacgagagataattatagatattgttacgcaaaattagttgatcctaatacaaaagcggtaacgaagcaatattatagtggtgaagatcctgatttaggagtctttgtagatattttcccctttgatggatttccagaaaatccagaagaacgaaaacaatttggcgatttatgtgaactctatcgtgcaaacatgatgtttacattaaaccattcgtacgctatatccagatcaaaagttaaagcaatggttaaaagggtgatttattatcctaagtaccgtcgactgttgaaaaaaggaaattactcattctggaaaaataaatatgaagaattagtgcgtaagtatccgattgaacagacgaagtactgtgggtacatggaatttattaatgaagtatggggagtttttccgatagaatggtttgagcattatgaggacgtagaatttgaggggcataaatttaaagcaattagagatcggaaaaagtttttggaactgagatacggggactatatgaaactcccgccaaaagaagaaagaatttcacatcatccctataaattttatgaaaagtaactatatgaattaaattaatttgtaatcgaagtaaggatgaataagaatgatagactataataagataatgattattaccctagataaaaaatctgtcctttattcaacagacgcaattgaacttggaatagacgtaaacagttattttaaaaaaagaaatatgtttgtcaaatgtttaaatcatcttgacagatatattaatactactttttccagaatagcatatggtgactggaaaaaaagattaaatgggatagaattactaatactaaattcacattttttttcaaaatcagttatcaagtacgtaaataaatattatccacatgttcgtattatgttaagctcaatttgtttgctagcatattgcttgcttgttaaaaatgtttgttgccttgaattgaatcaagacgccctacacatttagtttgtcttactttgttcagttttcaaaggtctacttcatcggaagcgtttatccgatttgtttttggctgccgtagcaacttttgtatcatatcagagtgacaagtgattgtcaactcttttttaaaagttttttcgatttcgtttttcgaaatctttcaacaactcatttatcataactcatcgtttgttatttgtcaagaacttttttgaagtttttttcgatagaatcaagcttcgcaagctgttcttttttaacgactcagttatcttatcatgtcattatcaacatgtcaataaatattttttaagttttttcagaaacgtgatataacatccacttcagaatcaacgctgttaaatttatcatgtatttcttccttggtcaactataaattaagcattactttgtgaaatgatttttcgatcaattattattattcgttatacaaacgttttctacatattttgaaaacaaaatgcactaaaaaaatatctatagcagaacatttcaatgtcttttctggatcaaacaataaaaaaagaagtttgaaaaaaattcaaacttctttgttcgcttaatctgtattttagaagaaaggcactccctctacttcgtaagttccaagaacagagcgcatttgacctggttcttcccaaatatatccttcgcctaattcttctctttgattcttttgttcagtctcaaagacaaacaacggaacattttcctgattaatatgtgtatttgtcaattccatcaaactaatcttgctaacatcgatatgaactatttcttttaagaaattaagtatattcgctaaaccagtcttcccttcagaaagttccgctaacgcaaattccaacttgtcatcaattgaatggactaaaaattttttagaaccatcctccaaatgcaacataattgtaccagcaactcttttgcttgccaaaatttccacctcgatcaccttgttctatggcttacataaaaattctagcacattttcagaaaaaatacacactttttatttcttattttctttccgttctaattcagataacgcttcttctatccaaataggtaactgctccgcaatagtagcaaaaccgattttacgatttttattcgtgaaatatctttttctacgataaggaacagctggatttgttttttctaatgttcttaaagataaactgatttttttggaatattcatcaatgtcgatgatctgaacggttactggctgcccgacttttaacaatgaatggatatttttcgtataaccggattgtacttccgaaacatgaataagtccttgcgtctcattatcaagagagacgaatgccccataaggctgtatccctgttacttttccttcaattatttgtccaattttataagtcatctacttccctctcttcacatttatcattatactgtaaatagctcaaaaaaagaagcgacgaaaatgactggaggtattgagatgatcgaatttgataaaaagatttcaagaaaagatacagaaagtgtaaaatgggacgcgattgccgagacatatcaaatggatgatttacttcctttgtgggtagcagatatggatttcttatctcccgagggggtagctaatgcgtttagtgaatacatcaaacacggaatctttggttatgccactctgtctgataaactctatcaggctatcattcattgggaacgtcaacgccatgctgttgagttgacgaaagaaaatattgtttttacaagtggtgtgttaactagtttagctgcagcagtacaaacttttacaaaaccaggtgattctattttgattcacgacccagtttatcctccattttcctctattatagaaacaaatcaacgtcacattgttcgaagctctttgctagaaaaaaataatcattttgtcatggacttttctgacatggagaaaaaaatagaagaaaacaatgtaaaagcaatgatcttgtgcaatcctcataatccaggaggtcgcgtttggaacaaagaagaattgaaacagttaagcgaattgtgtttaaaacatcgagtgtttctgtttagtgacgaaatccatcaagatttgactttattcgatcatacatttacttccatgctgacgattaatcccgatttggacgatttgctcattgcctttacttctgcaacaaagactttcaatttagctgcaatcaaaaattcaatggtatttatcaaaaatccagagctgaaagataaatttgaaaaacatctagtgatgaatcaacagcacgaaatcaacacttttggtttgattgggactcaagcggcttatgagaccggtggagaatggttaagtcaactgattccttatctagaaaaaaatgttcaaacagttaatcagttttttgaacagcattttccgaaagtgagaataatgaaccctgaaggaacttatttaatgtggttggattttaccgcttatatttcagacgaccagaaattagagaacactctagtgagaaaaggaaaagtcgtattaaatcctggtatcacatttgggccttccggtcatggacatatgcgcttgaatattgcttgtccagaagaaactttactagaaggacttcatcgaatcaagcacgctttagaaacaatcgaataaatcagttatcaaagtaaaaggacgagaccttactaggtttcgtccttttctataattactccgtatcataccaaactattctgaaatttcaattgtttctatcactacatcatgtacagggcggtcttgtggaccacgttgcacatttgcaatttcatctactgtatccattccttccagtacatgtccaaagactgtatgtcggaaatctaaccaaggggttccgccacctttatacgcttcaatgatttctgatgggaatccagcaccttctaattgtccaagcatattagctggcacatttgtgttatttacaataaagaattggcttccgtttgtgtttggacctgaatttgccatagataaagctccgcgaaggttgaacagttcacgactgaattcatcttcaaaactttctccataaatactttctccacccattcctgttccagttggatcgccgccttgaatcatgaaatcaggaataacacggtgaaaaatcacgccatcataataaccttttttggaaagttcaatgaaattttgaaccgtcttcggtgctagttcagggaataattgaacagtaatatcaccacggtttgttttgataacagcttttggtcctttttcactttttaaatctagttgtgggaatcccatattgtttcctcctattatttgcatacttcataaataataataacataatacctaaccttccgtaaaaatactagatttgtttttctttatttttttcatcactgcctgcattccatgaataaattctatgactgaccatttcaacttcaaatatttttgagaagcattctcaattaaattctgctatagtgtgaaaagggaggaattttttatggaaatctatgacattacaattatcggtgcaggtcctgtggggatgtttgccgctttttatgcaggaatgcgccaggctaaaacaaaaatcattgacagtctacctcaacttggtggtcaattagcaacattatatcctgaaaaatatatttacgatatcccaggttatccagcaatcaaagcaagtgaattaatcgatcaattagaaaaacagttaactacttttaaccatacatttcatttaaaagaagaagttctctcgcttactcgtgaagacgaagttatcgagatcactacaaataaaggcatacattattctaaagcagtcattttagctttaggaaatggttcattccagccaagaaaattgaatttagataatgctgaaacattcgaaaaccacggattggattatttcgtaaatgatttgatgaaatatgccggaaaaaaagttgctattgctggaggcggcgattctgctatcgattgggcattgatgttggagcctattgcaagcgaagtttacctgatccatcgtcgtccggaattccgtgcgcatgaacatagcgtatcacgtttgaagtcttcatctgtcaacttgcttactccatatctaatcgatggattgtctggcaacgatggagaactttcagatatccgcttaaaaaaagtgaagagcgatgaaacaattgatttgatgattgatgctatgatcgtcaattatggattcacttctaatttagaacatctctcttcttggggacttgatagtaccagaaatgccatcactgtaaaatcagatatgtctacttctattccaggtgtttatgcagctggtgatatatgtacctatgaaggaaaagtgaaactgattgctactgggctcggtgaagcacctaccgcagtgaacaatgcattacactacattaatccaaaagaacggactcagcctggtcacagcacaagcttatatgataaaaattttcgtcctagttgattttttagattcctctgcatttcaagcgagatccgaaagcagtttcttgcatttttttcatgttccgttaacatgaaatagagaaagaaaaaataaagggggagcaataatatggtcgtcaaaactgagactttagaagaaaaagcaagagaactattgaaggaacgtggcgtaactgtagaagatatcgcacaacttgtcatgtttttacaaaaagactatatttctgatttgactttggcagattgtactgaaagtgtcaacagcgtattaacaaaacgtgaagtacataacgccattatcaccggaatccaattagatatattagcagaaaagaaaagattgatggatccgttgcaacacattatcgaagatgacgaaggtctttacggtatcgatgagatcttagctttatcaatcgtgaatgtttacggtacgattggctttacgaactatggctatatcgataaagtgaaacctggtattttaaaagaactaaacagccacgatggcgttcatgtccataccttcttagatgatatcgtcggagcaatcgccgctgctgctgccagtcgattagcacacaaagaaccagaaaaaagaagtcgacttactcaataaatcaaaaaaagaaagaaaacgtctatttagacgagttctttcttttttgtttgtttcaagctatttttccctaagaaaagaaaaatagcaaaaaatacttctaatactacaaagaacaagataaagctatgcatgaaaaattcttctggaagtacattgatgattggatcagtcacaggatcgaataaccagtcatcgttgttgaaaaacgtttcatgaaaaaggataaaaaagcgatcaaatccgatcatcatgaaaaaaccgaaaataactggcagcaacatgccaatctgaaacggacgaatcaatcgccaaagacgatcattcttttgcaaatatctgataaacaaaatacttggaatcagagtgatgaaaaatacagcataatccactaaaaacaaaattttcacttcataaaaatgatgagcgccgctagcagaaactggaaagtccggcaaactgaggactgtttggaagggattattaagataattcatcaggtgatcaaaatttttcagtaatgtctcttggtctaaagaagtataatccaaaatatgcaaatgtccgatatcaaatacatacagcggtcgaaaattgatcgtcactccaactgccaaactgatcagcgtcagaaacaggctgaataatccggcatattccaaccaccgccatctcgaatttttcatattagaagctccattcatccaatgatcgtttcacataggtagctgggataggcagcccaggtacatcttcttcttttgtgaaacctgataaaacgagcaaagtatcgatattattacgtatccctgcttggatatctgtttcatagttatctccaaccatgattacttcttctttttgcagacctaatacttcaacggctttatccataatgattgcttctggttttccgatataaattggtggagtttgggttgctgtctcgacgaaagagatgactgacccagctccaggaagaagacctcgttctgtaggtatattcttatccggattcgttccaatgaaagtagcccctttttgaatagcaagagttgctttgacgaccttttcataggtcaaataattatctagccctactactacatagtcaggaacctcttcttcccatgtaaatccggcagctaaaatcaagtcaatcaatccggcttctccgataacatacactttttttccttttccatctgttttcatgaaatcaattgtagccaaagtagctgtataaactgtttctggtgctacatgaatgtcaaactcatctgctagacgattagccactgtttctggcgacttagtcgtgttattcgtaacaaataagaaaggcaattttcttttttgtaattcttccacaaaccgttttcctgccggtataggttccgtcccacgataaatcgtcccgtctaaatcaattaaatatcctttataatccattcatccactactcttccctttttcttatcgtaaatgctgtttttgttttttccacttgtttagattgttcctgtttttttactttttcagaggtttttgctgactctgtttttcggtttttaataaccggttttttgcgattcgatgtgactggtccttttttctcatcgatatacgcacgattatggttttttttcttttttcggcgctgagttgtcttttcttttttaccgccgattctttcgatgacaaaatacgcacaaccaaaattgcaatattcgtaaagatagtcttccaatgaatcaattcgctgatccggatgtgcccgtcgattatccgctcggaagaatccttttaaacgtagttgttcataaccccaatctcctacgatataatcatatcgggctaatacatcactgtatcgttctcccagtttttctgcattaaatccttcacgataatcggacacaagccgataatgtctttcgcctaccaaaaaattactgtcatctaacagcgtcactaattcacctttgactttttctgctttcggctcctcgacgatttcttccaaagcagctgtcaattcttctgtgactgttttttcctgttcagctgatgactttttcttagcaatttctgttttatgctcaacgttctgctgttcattttgttttgcagacatgcgttcaccacctatcttttttattataccttgtttttatttgattgggtagtgagctttcaagtaatctcctaccacgcttcggataaattcaggaaacaaaaattcattttttccaacaatttcgatcgttggaaaaaatgggacaaacattagatgatcgacggtagtaaaagtataatttttagtcggatcgactggcttgttcttccaaaagacttggtggttaacagaatcatacgtgattccattatagaccatctgtccaaaaatcttgccgcgaaatcccattcccttcatcggatagttacgtaaaaaaagacgatttttttctatttctaaaactaaacgaatcagatcatttccacccaatgtgacattcagcaagtgcattggatgtggcaatgccgtgtgaagctgatcttgattgacccgtccttttggaatttcagttaaaaacagaccactgtttaatattgcggcgtccgtctttcctcgttctttcaccgcctcaagggctacttggataaacgaatgctcactgaagatatctaggcttaaagaaaacggcaaatccgctacttctttttcttttagcagctcatgcccctgttctaagtaaccgtttacctcttgttcatcttctgtaaaagctgtcattgtttctgtagggatggctttggccgaatgcttaaggatttttttttcttcatcgatggttaaatggacttctcccacatactgaccgtatttgccagctgctgctatttggacatcgttgactacatgaccttctctgaataaatgatgggtgtgcgaacctaaaataacatcaattgctggtatttcttttgcaatttgtaaatcatcttgaatcccgagatgactcatcaaaactaaaacatccacttgtggacgtaaatcttcgactaattccggcaaaatatcatatggattgcgtatgtcccagccatttggattatacgtaagcgggaacggggcagtaaatgcaatcaagccaatttttgtctggtgtttcgttgtaatgattttatacggtttcgtccatatcggtggctgcaacgtatttttatcgaacaagttatcaaggatgatatcaaactcagcatgatcatataaatgatttagatcttctttggaatttcctacgccttcattgtttcctatcgtcgctgcatcataaccaacttcattcatcagcaagatattcgcctgtccattcgttgcctctgataatggatgccaacgatccacaaaatcacctagatcgactgcaatcgttgtcgtattttctttcttttcgttttctcgtttacgctgatctaagaatcttctgatccttggccaattttctaaatgtgaatgcagatcattcgtatgtaaaatcactattttttccatgtgtcctctcgcctctctttatcttcatcataccacaggcagctttttcttccattgaaacaagctccatttcagagcttttcctgcctaaaagcaaattacataagtataatattcgataaaatagtctggctaaaagaacgaaaaaccattcagttttatagcctaattatttctagaaataaaaaaaaacagacccgaaagtctgtcgtcgttttattataatcagacacatggcggaacctgcttagtgctgcttccttccagacctgacacgcttcacaagcccaccattgtcctagcctttcggcaaagaatagtataccttatttttcattcgttgactagtctttttttaatttcttttttcgctgacgtagctttcgaaaaaagtcagtcaaaatcatcccgcattcgtcttctaaaatgccaccttctacatacgcttgatggttgaatcgttcgtcttccaaaagattcatcaaagtgccggctgttccgcctttcgggtcatatgcaccgaaataaacttctgctacacgagacaaaatcatcgcgccactgcacataggacaaggttccaaggtaacaaaaagagacgcattttctaagcgccaacttccaactttttcacaggcttccttgattgcaagcatttctgcatgtgtagtagcatcttgtgtcgtttctctaaggttatatccttttccaattacttctccctctaatacaaccactgctccaatcggaacctcatggagcacttctgctttttttgcttctgccaatgcaaggcgcatccatttttctttatctactgcatcaagatttgtattaaccaattattcttccctgcctttgtttttcttgttttactttagcatatgacaaaaaggctgtaactaacttttttttctatggtaaaataaatacaagaggtgaacaagatgaaaatgaataaattacttgctctttacccacaagcacagaaaaaaaactgtccagcgtcagaagctgatatcctttcttttgcagttgatgatgcttttatttggatcaaaagcgattcactatcccaacaagaaactagtcttttgaaagcgttattccctatagtcagcgatcaaaaaaaacatccatggtatcactatctttttaaagatgcttcttgcatccaagaaaaaagctttcgcttgatccagcttcacgtcgaatcgaaaggagaattcttaaaaaaagaatggcaagatactattttggaattatttcgctattctgctgatttcttcttttatacagatactgatgctctcttgatcgaacaaaaaaattgtgattatcttgatgctgctgagatcaatggtatttttctatctttagatgctgattttgatacgacaacgtctgtattcgttggttcttttcattcaccaggtagcgaccttgtccctttgtttgctgaagaaagaagaatttttttaacagagcaaaacaatctctatactcacagccgtactttttctatgcaagatgttgctttacattactatacaaaagatgtcatgaaagatagtgcgttgatcaaaagttacatagaactgatcaaacaaaatgaaatggaagagatcattcaagaattatggaatgaattaggtaatgtcagctctgctgcaaaaacattgtttcttcatcggaatacgctaaaatatcgaatcgaaaaatttcaagaacaatcaggtttcaatctaaaaaaagccaatgatttactgttttgctaccttttattgattcatgaacatgattaaagataagttaaaggggttatgacaaaaattttgtcacaaccccttatttcgaatgaatagtgttcaaaagctagtttctcttacatcattttttcaacaaaatgcataaggcgatcttttacgtcttcggttgagtctttgatggaatcaccgtaaacagagattttcttttttcctgattttatttttgctaacatccccatcaaagaatccaagtcactatctgacagatcatctacgatttccatcaatttttcatttccatcgaatttgtcatggacgaatttttttacttttgtccgagtagtcatatgatggatcttttccattacttttcccgatacgacgactgctgtcgctacactggcagcggctgctacgcttaatccaattgttacttttgttgatgttttcataagtatcagctcctttatatctacttcaatcataccatagacaaaaaaataaacgaactaatccactcatcgaaatcagcgaaatcttaatcctttaggaaaaaagttctttactgttccttttacttgtttaccaaaaccgacaggtatcttatccaatactaataaaacccatccttgatccccatcacgttgaaatgtttctcctgctgtgtaagattgccattccttttgagtgatcgacaaacaagggatgttttctgtctttttcatagcaagtgctaaggcatagctaggttcaaatcgattctttttgaaatctcctaaatgcaaacctgtacgcatgactttcaaaccatcaagagaagggagcaactcaggaacttcccaaagatgatcgttgaacactaaaagtctcccagtgatttcataatggaaatccattgaaaattccgtccaaagtttttcctgttcttttgtcaattgttctttccgtttcttacgtactttcttttctttacacgtcgggttttgtccatgaaaagtcaactttgcgacaaaatgcccttctccttgattttcatgaggccatatacgtactgttttgtccaaaccatctacgcttccccattcaggacgtcctgaactaacggtttgagacaaagggatttcttcaattgttactggataattttctacaagccagctaataatctcttcattttcttctggtgcaaacgtacaagtagagtagatcagctgcccttcatgttttagcatctttattgctgaagacaaaatctcttgctgacgtttttgacagtgtagcggagattcttctgtccactcttttactgcattcgggtcttttctgaacatcccttcccctgaacaaggcgcatcaaccacgattcgatcaaaaaaaccggaaaaatgaggaacaagctctgcaggtgcatgatttgtcactattgcgttcgaaactccccatcgttctatattttctgataggatcttcgcgcgtttcggaaatatctcatttgacactaataaccctttgcctctcatttgagcagctaattgggtcgatttaccgccgggagccgcacacaaatccaacactttttctccgggttttgctgcagcaactgttccaacgatcattgcacttggttcttggctatattcgtacccagcttgatggaggaaagactttccattcacagtgccaagaaatccctcattgctgtagggagcgggttgcaattcttcgctatggtaagtttgaaccatagccaatcctgccggttttagtggattccaccgaaatcctttttttgcgcttccttgctcaagtgcgcaaaaaaattcagttgattcttcgcctaaaagaagacggtattttttgataaattgctgtggtaacgttgtagcttcctccttcattcaaatgtttcgttagacattttacaatcttttttacgaaaaataaaggtggctgatctactttttcatgttgctgcctaagataactggtcctttaagatactttccaagtattcatccgtcacctcgtttttatcccaaacagcgttcatcgtttcaaaaaaatcttgagaaaaattatctgagcttaaacttcccaatgcattaagccaaagcaattcaagcaacttttcttctttgattttcgtgtggcttttgatgtatgagaaaaatggccgtttaaatagcgaattcatgtctaattcagattttgcaatgattccacggatactttcatggatagaaaaaaaatctttcagcaagtagactgtgcttagaacatcattggaattgcattcagctaagtatcgttcaaagcaaacagtgatttcttctaatattttctcctttaacccgctgatcgatttgaaatgtgtataaatcggatatgtagagcacccgcagaaatccgccagatctcttgcagtaattgatttcattccatattcttccacatataccatacttttgaacagcaagtattctttactataattcgttactctccccattattcttacctccttccctcttcaactaccctctaataaataacatacaaaattaaaaaaatagcgaaataatcactgataaccttcataatcactttagatatatccattaaaaatcaagtatatttacttcttatacaagaaagccttgacaaaacaccctatgaaataaacaatagaataaacaaggtgataacaagatttaaataacaatatatacaaacaaaaggcggtactctgtgagaataacacacactgaaatgactttccactcacagtttttgtctaactatatacaaaaacagaataaaaggaggctattatgttaattgaagcaagaaaaaaagagttgcttgttctgcacagggtcattcaaaaaaaaaattgttctttacaggaattagccaatgaattgcatattccaaaacgaacaatcaaagagttgattcggaaagtaaatttttcgctcaagcaatttttattgatggaggaatttatttattctaaccataaaggagagatctacaccaaagaaaccgatcagcctaaaaagctagctgttttttataagttaagattacgctacctacaagaatccaatcgttttaactatttaatgttgctgatcaattatccacaatctgctgtaccaaaaaagtatttacttgaacaactttatatatcgccctcctatctcgaaaagctgacaaaacagctcaatcattcattaaataaattccatttaaggatcgtatctgtacaaaactgctgtgttcttgaaggaaacgaattatctatccgcctttatctttatttttttctttcagatacattcgaaggagacgattggccgttttcctctcttgaattaaatacactaaaaaagaaaagtaaggatgagcacagagaaaaaaatccaaaacaagaaaaaaacatctatttattacttgctttattcatatgtcgtaacagacaacaggcacgtttttcgaaaatttctcctgaaattactgaattaatggatttgttgcagcgtacacatgattattcagaatgctttacttctttttcagcgatttatacctgtgaagaggtagaaacggaaagagcctacttcaattattttttctattgtttttttccaaatcaaatttcattccaacaaaaacaggtgattggtttcttattttccacaagcaaaaaccttatttgccaacaagtcgatcaattgatgacttacttaactcaacagtttcctatcaatcatttggaagacaaaaaaccgatctatttttattttctcgtactagcagttattcttttggaactgttaggtgaatctagcagtagcttttctacactctgctttccagaaactacctccaatcaaacagcttcttttatacaggaaaaaaaattaagagaaaaaatcgacacaattttttcaaactctagaaaaaaagttcaattaagtcaataccttagtcaattgatccaacacttattacaaacagaaatgaaagaacaattactcatccacttgcagataaccaaaccattcacagggaattaccatctgcaaagtcatttacagaaactatttcgcaatgaagcaatcaagattatcgaatgtcctgaacatgctgatttgattattacagatcagcatgagaaaatatcagctgaaacggaaactttctatctagatacaaaccacgatacagtattattcggtgagttgataaaagcgattcaagaactgtatatgaaaaaaagatatgagaataaaacaaagagcgtgggacaaaagtaaagaacacttttgtctcacgctctttatgttaatctcttcggttaccgccaaacaataaaatcagacgcagtagttgcaagaatgtcgaaagcgccgctgcaacgtaagtcaatgccgctgcaaacaatacgtgtcttgccatcggtacttcttcttccgtcagcagtccgccttcactcaaaatttggattgctcgacgagatgcgttgaattcaactggtaatgtcaccaattggaagagtaacgctaaagaaaaagcaaaaatcccgatattgatcaacgtagagttccaactaagcaatacacctaccataatcaatgggaacgagatcatcgaaccaaagttagctgcgggaacaagtgccgcacggatcttcaatggaacataccccgaagcatcttgcaccgcatgtccgcattcatgagctgctacacctatcgcagcaactgaagtagattgcgcagtcgcttgagacaggctcagcatcttattacctgaattgtagttatctgtgagatctccggcaatttgttgaacgccaacattatttatttgttggctttgcaatatatattgtgctgcttgtgtaccagtcacgttgtttttgcttctcacttgatcatatttgcggaaagtactattgacataagctgacgcaattccggaaatgactaatccaagaatgaccaaaagaaatgtcggatctaaaaaaccatacattccataaccatacattgtcgtttcactcctttttgtttcctttattttatcattagtagcaagaaaagaatgtgaaaagaccttgaatattctttaattctttttcacaaattccgatttcagtttcatcggtccaaatccttctactttgcaatcgatattatggtcgccttctactaagcggatgtttttgactttcgttccttgtttaatggcacctgatgcaccttttactttcaaatctttgatcactgtcacgctatcgccttctgacagacggtttccatttgcatctaataccactaatccgtcttctatgacagttttttgttcttctttgctccattcgttcccgcattctgggcaaatcaacagacctcgatcttcatatgtgtactctgagccgcattctgggcaatttggtaatgtcatcttctttctcctttaaaatctttagtgagcactattgtaacggaaaaagaagatgttgaaaagatacatttgtgatttttaccacaaaaggaacgttttcgaatgaagttgttacttcgtttctctactcttatacgatcggcaaatgtcttgaatctctttatagatttcctctacttctgctaaatcttttgcattcgcaccacttgctaatggatggcctcccccatgatggcgtttcgctaattcattgatgactggtcccttagaacgtaagcgtacgcggtaatgtcctgaaggctgctgaacaaaaataccccaagctagtacttcgtcgatcactccaggaagagaaacgattgaagccgtctctgaatcatcgattccatatttatcaagaatttcttgcggaaggattattcttcctgcaccattttcatccacctggatattttgataaagataaccggaaagtttagcgactttcatcggcatttgctcaatctctctattcaaagcacttgcatcaaatggataatttctcaatatcgatgcaatctctaatgtacgggacgtcgtggagggatacaaaaagcgccctgtatctccgacgattcccgcataaagtaaccgtgcagcttccacgttcatcttaaataattcaggaaacatcaaagcaaattctgcaatcatctcactacaactgcttgcttttgtatttacccacacaagatctccataagggtcatcattgggatgatgatcgattttgatcagcttttctgctaactgatatctttgatcactgattcttggtgaattagctgtatcggtcacgatgactagcgctccttgatagaaggcatcttcaacctcttgcatttctgctaaaaagcgaagaccttcaatcgtttcacctacttgtcgtatttctttttctgggaaactttcccgtaatagttcagctaatcctacttgtgatcctaacgcatcaggatcagggcgcaaatgcctgtggataatgattttatcgtatttttttattgtatctactatttcttgctgtactgtcatttcactcctgctttctaagaacgttccattacttgacaaacaacgattgctttggaaacgatggtattttcaataaatacttcgatatccaatttagcggaacgtctgccgatttccaatacacgtggacgaatgtccaactcgctttccaattggatcagccgcaaataatgtaggttcacttgttcaatcaagatatttcgtttttggttcatcaccattgttttttgtgcgacatcagaaatgatttcgctaagtacaccaaaagaaatggttccaacaccattgaccatttgtggtgtcactacaaatttgaacttagggttttccaaacggttcccttcacgatcggtatcaatcgtatggatatttccagatatctgatctgaaatcgtatctgcaatctgcggttgtcgctggacaagctgcatcgctttcattacatcttgccgggtaatcaagccttccaatgtcaagtcatcggaaacgaccggcatgacttccagcccatcccagatcatttgatggctaacagaagcaatactcattgttttctttacactgattggttctttcgtcatcactcgatcaatgatctgatttggtgatttccctaaaacgtcttttgccgtaacgatccccatcaaacggtgatggcggttaacgactggaaaacgtgaatgttgcgtttcttctgacaaacgttgataatcagatatcgtatccatctgatgcaaataatgtgtcttttctgccggcatgtagatatcgctaacaagcataatatcttttttgatcaattggtcacttaatgctcggttgatcatggtagcgactgtaaatgtatcataagaagtgcgcaagattggcatttcaagttcatcggctagctttgcaatctcagcagtcgtattgaatccgcctgtgatcaatactgcagcgccatcttccaatgctaatttttggacttccgcccgattgccgacgatcatcagtgagcctggtgtaatatagcgttccatggcatgtttagtcatcgcaccaatgacgaatttattcaagaccttgtctaatcctgccgagccacctaaaacgtccccctcaatgatcctgacgacttcgccaaatgtcaaacgttcaatatgtttttttaatttacgttcgatacgaatcgtacctactcgttgaatcgttgaaactagtccgacattttccgcatctttgattgcacggtacgctgttccttcactgacattcaattcttttgcgatgcttcttacagaaattcgattgcccacaggtaaactttcaatatattctaaaatcaaatcatgttttgtcgccattttctgcctacacttccagcgtttccgagacgctcattatttttccttcgctatcttccagtaatgctacaaaagattcaggatcttgttcaataacagggaacgtattgtaatggattggaacgactttcttggcacgaattgtttgtgcagcccgagccgcatcctctggtcccatcgtatagttatcaccaatcggcaagaaagcaacatcaatatcgaattcctctgcaagcaatcctaaatcactgaaataagctgtatctcctgcatgataaatcgttttgccttctgcttggataatgattccgctaggctcacccatatactgaacgataccatctacttcatagcttgaactatgctgtgcatggacgaattttactgtgccgaatggaaatgcatgttttccgccgatattcataccgaatgaatctactcctctgctatttgcataatcagcgatctcaacaatactgataaccgtggcttgattttcttttgcaatagggatcatatctcctatatggtcactatgtccatgagtaatcagcaaccaatctgtctttacttcttctgcagttaaatctgacaatgggtttcctgtaataaacgggtcaatcatcacacgttggccattttccatttcaatcgttaaacaagaatgtccatgatacgtaattttcatattctacacctcacgttttctctgtatcttttttattaaaaccgatttcattacttgcacatcaatgaaaaaatatagttactaaatatattttcattggattgatagtacagtatgcacaaagtaattgtaacagataatacaggatgcaccaagtaccaagcagatataatctcaagtttgagctctctgcttggctcctcttctcgtcacttaactaattaaatcagcgtaaataggatggacgattttttctaaatcagctacttttatctggaggcttctcccgatttcaccgctcgacacaatcacttcttctttttcttttaaagaactgtctgctaaaaaacaataatcaggatgtgcgagttttattccaataggggtattcgctccgtgaggatagcctgtatgtgctaatacaaaatccattccaggaaaaccgactttacgatctttcgtcacttgtctcgtttttttataatctaaatgatcattcaaaggaatcaatgcgatgatcaccccggttttgttcccttttactacgagagttttacatatcaaagctggatcaatccctcttttttgtagttcttctgtgaaagatccttctactatatgactaaaatcaagtggttgatagctgattttttgttcttctaaataacgttcgacttttgtttgactcatcattgatccactccctttattctatcgtttattatagaacgagggatactgtattcaaaaatcatttgtttccctcaaaaaaagagcaagacgagcactctatagagagccatcttactcttatttatttatttcttatttcgacgttgagtagcttccataatgactggcaagatcacagggcgtcgttttgtttgttcaaataagtaacgacctaattgatcacgaatgtcttgctttaatttgctccactcaaaatcattgctttctaaatgtttctcaacgatcgtttcgatcatgttgctactttctttcatcagatcacggctagcttttacgtaaacgaatcctcgtgaagtgatttgaggttttgagatgattttcttctctcttcggctgatagtgacaaccgctacgaaaatcccatcttctgataagattttccgatcacgtaaaacaatgtttccgatatcgcctatgcctaaaccatcaatcattacattttctgcacttgtagttcctgcagcactcatacgtttattcttatattccagcacatctccgcgtccagtaatatagatatttttgtaaggcatccctactgcatgagccaaatctgcgtgagcagctaattcccgatattccccttgaactggcacaaaatatgtcggcttcatcaaattgatcatcaattgcaaatcattaggattggcatgaccagaaacacgcatattctcagaaatcaatttcactgttccaccagctcgataaatgatatcttccgttttcgccacgattgtttccatcgcgatgcttggcgtagtagtgatataaaccaaatccccttcttcgatcttgacattacggtgtgtgccgtttgccattttttgcagagacttgatgggttcacccattcggccagtttctaaaatgattagttcttctggatcatagtttttcatgtctttcaatgtaacaagcaaatcttcacttggtaattgaagtttttctaaacgcatcgctgttcgaataattcgttcgaaatcttgaccagtcaagacaacttttcgttgtgctttttctgctgcgtccaatacttgttgcactcgttgcaaattacttgctacacaggcgacgatgatgcgtccttcccaatatttgatcgtatcaaatacttcatcagctatctgagcttcagaagctacaggttgaggattctctgcatttgccgattcactcagtaaagctaagactccttctttgccgatttctgccaatcgtgcataatctgtttgatacatcgggatagccgtttgatcaaatttaaaatctcccgtataaacgatactaccttcttttgttttcagattgatccccactgaatctggtatcgtgtgagtggtacggaaaaagctcactactgtttcaccaaagtcgatttctgtatgctcatctaccacatggaaatccttaaatcctttggctgcttcgttacgactgacattcaattttgctaactcgatcgtcaactccgttccaaatactggtacagaaattttcgacaacaagtaaggaagcgccccgatcgcatctgcgtgcccatgtgttaaaaagacaccagctacacgatcaatgttttcttctaaatacgtaaaatctgggatgacgacgtcgattcccagcaactcattttcaggatattttagcccacaatctaatatgaaaatatcctcgcccacttctgcgacatacatgttttttccattttcgcgaacgccgcctaatgggataattttaatggtactcacaaatttcacctcttcttatgacatccaagtttaaagatgtcgattttcttctttatctaaatttacgagccattccaatgaagcacatgcaaaatcactagttctcaacttatggagaatcagcaggaaaattaccagcacatccgcgttctgacagttggatgggcattttattttggatatacttcattaacaaaatggatcttttgcgaaacgctatagccagaatccttatataagtattcggctgttccccattattatacaacaaatgaactaaatcgctagtatcagcaattgttagaatcactaagcaaatgaaaattcctctgtaacatctaggatttcttttgctgtttctctttcatctcttcttcgtcggtttgaaacatacttttttcattttaccacattttttgcaataactatagtgactttttatatatacagaacctcgagttgatgatatgcaaacagcataagatttaagctagttttaagataggttgtctattatcaaaagcatctactaggagcgatgcaagatatgaattttatgaaacgtgcatggaaaagtacaaaagtaaaatggggacgttcattgttattgtttgccgtgttcacagccattcttatttttgtgctagctggcctcacgattcgaagcgctgcagaagaagcagtgaatcaagcacaaaaagaagttggagcaacagtgactttaagtgccaatcgagaagcttcatttaaaaaacaggaacaaacttcttcaagcaattctaccgctgaagaacgtccagatccgggcagtttttctcttaccccagtatccttaacggacgcggaaaaaatagctaaattagataatgtaaagagctattcctttgaaagttccgcctcagctatggcaaaagatggaataactgccatcactagttctgattcaagtgaagacagttcagaaactaccgatgcaggcggtggacctgccggaggaatgggcggaaatccgcaaatgactcaagcagattttcaaatcagcggtgtgtcagcaactgcacaaaatagtactttttctgatgggacagcaaaaatcacggatggtgaaggaatagatgacagcgacaaaggcacaaacaacgtagtcattgattctacgctagcagaagcaaatgacctgacagtcggagatactttcacaatcacgagtactgaagatgaagataccacttatgaaatgacggtcaaaggaatttatgaatctagcgaaacaagtagcagtatgggtatgaaattcaacttcatgaatccgtcgaatacactttacacctcttatacttttgcaaatgaattaaatgggacatctgacgataacacgatagattctgctgtttacactctatctgatccagatgaaatggataaatttctcgaagaagcagagaagctgatcgacacagatacatttagcttacaatcaaatgattccatgtatcagtcaatgttggaacctttaaacaatgtggcaagtttttctaaaaatgttgttttactagtggctgtagccggtattatcatacttactctgattatcatgattaccatccgggagcgtcggcatgaattaggcgtcttgttgtctttaggagaatccagaagtaaaatcattctccaattgtttaccgaagttgctatttgtatgattcttgcattaggagttgcttcgattagcgggaacgtcgtcgcgaatgccgtggggcagcagctacttgaccaacagacagaaaccacgacacaaaaccaacaagctcctggcggtggacaaatgccaggtaacggacaaggcggtcaacgtgggggtcaacaaggaaacatgaataatccatttgctgtttctgatcaagtcagcgaattggaaatcaatgtcaaacctacacaattaggactactagccggagtagcatttggaatcagcctgctttctgtctttttagcttctatagggatattaagattaaacccaagaaaaatcctattaaattaaaggaggaatttgatgttacggacagaacaattgggattttggtatcaagatccgcaagatgcgctttataaagatgtagaactgaatttcgaagctggaaaaatgtacgctattttaggagcaagtggttctggaaaaacgacttttctttcgcttatttccggattagatacaccaaaagaaggaaaggtatactatcaagatcgttcactgaacaaaatcgggttaagaagttatcgtaaaaatgatgtctcgattattttccaagcttataacttgcttccttatttatcagctctagacaatgtcataacagcaatggagatcgctaaaaccaaacaagagaattatcgacaagttgctttagatcgactggctcgtgtaggaattgatgaagtattagcaaaaaaacaggtgaccaaactttcaggaggtcagcaacagcgagtcgctatcgttcgtgctatctgttgcgaacatcaactgattgtagctgatgaacctactgggaatctggatgagaccgcatcacaagatatcgtcaaacttttccaagaaatcgcccatgaacaaaatcgctgtattatcatcgtgacccatgaggtcgaagtagcaaaaagctgcgatgaagtctttgaactaaaaaataaagaatttcaaaaaatagaagtttaaaaaacaggataactttcaaacaaaaaatccgaaccatatctatgaagcagatacggttcggatttttatttgcttgattcatttagtaatgaacgttgtttatttgttttcatcttttcgagagaatttgtctttgatttcatcgcccaaatcacgagctttttctttgatatcagaacctagtgattgtgcttttccttctgtttctttgctcttgtcgtctgttgctttgccgtatgcttcttttcctttaccgactactttgtctttcatgtctttagaacgcccttttaaatctgccattgtgtttcctcctcttaatttgtttattgatctactttcagggtaacatcaacaacagatacagacaaacagaacgctcgttttctaaaaaaggatgagacagatagtggatcaaaaacttttttcgaaagttccccatactttgacttctttttcttggaccattatttctcctttagcaataactgtatcgatatcaagcgtttctttgtccaagatacacaagtctgcatctgcgccaatttcaatttttccttttttatccaatttcaatatacgtgctgggttactggttatagctcgcaaggcgatttccagaggaatattttctttttgcacagcttctttgatccctactagcaatgccttagcacttcctactcctaaccctaggaaatgattgttttcatcaaaataaggcaagcttccttgtccatctgaggtcatcgtgaaattatctaaagaaacatcttcctcaatcaatcgtttcaatgctttactgaagcgcacttccccatctgtcttctcccaaaaatcaggatcttcgctagcggtgaagtcaatcgtgccgccacgtttagcaaatgccacgcaagcttcaaataattctggtgtacgattcgcatgagtaggcaaaaactgtgtgatcggaatttctgtttcttctacaattcgtgtcaataactctagctttctttttcctccgcctaagtggacattgatgatcccagcttttcccgacaacatgcctcctacacgagcatctgctgctgcacgggcgaactcttcaaaacttggctgagaagaacggtgatcggatactgcgatttctccgattccgatgattttatcgattgttaaaaagtctttgatgatcgaatctgttactgtttttaccggcaatcggtacgaaccctcgtacacataagtggagattccttctgcttcaagtcctttcgctttgctgatcaaagcagtcatatctcgaccttctccgtctgttcccaagcaaccgacaactgtcgttacaccagctgtagtcaattgacttaatgtaacttctggtgttcggttttgataaccgccttctcctcctccgcctaaaatatggaaatgacagtcaatgaaacctggagtcagtacttttccctcacctgaaagttcttctacttccactccttcgtagccgccttctagctgttcttctacagccaaaatcttcccaccggcaatcaatacgtccatttttcctaagtaatctggtgcaaacacttcaatttgtcggatgatcttcatacatttttcctctttctttaagtataactgatgataggatcttaaaaaataatccaaacgatagaatctttactcctttgattttaccgtaaaatgacggttcttggagtcatttatctactgtttggattactttttttatttacttatgtctccagtactactgcagaccgatcgcaatagcaatcatgatgaaaatagttcccaaaacaaacaggaatccttgcatcttgatttggaaccttgcccattttgcccattcgatccgtgcaacacctaacacaccaatcaagctagctgatacgggcgtaaaagcatccatgaaaccagaaccaagctgataagcaagaactgctacttgtctggatacaccgactaaatctgccaatggagccataatcggcatggtcaaagctgcttgtcctgaatttgatgtaacaaccaagttgaacaaactttggaagatatacatcgcccaagcgccaatgacagctggcacaccggtcaatgccgtcccgattccatgcaaaatcgtattcaaagctgaaggaacagacgcatcggatccacctaagacgagaaggattcctttggccatccctactacgattgctgtaccagctaaatcagctgcaccagattggaaagaagaagcgatgtcattgactttcattccatctaatttgaaaagaacagcaatgattccggcaactaatcccatcacaaagaattgagaagcgatttcggggatgtaatagcctttttgagtcacgccccaaacgatccaaacaagaacagctaacatctctactaaaatcagtttatgcccaagcatgaattttttattttcatcagatgtctttttgatatgagaacggaaataatcatctgatttataagtcaacgaactttccggttttttacggattttttctgcatatatcatcatataaccagctgctaaggcagtaacaactacccacataatcaatcgaaatgtcgcaccagacaacactgggattccagcaatcccttgagctacagctacgctaaacggactcatccaagaggtcgcatttccgacttgagatgcgacataagtcacggttactgctacgatcgagtcatatcctaaggcaatgacgaatggaaccatcaccattgagaatggaattacctcttctgccatcccaaatgtagcgcccccgaatgaaaaagcaaagaataatagcggtaaagctaaacgctccagtcccttcgttttactgataaacgcatagattcctgcatcaatcgctccggtacgcataataataccaaaagcacctccgacaacaaggatcaatgcagcaatccctacagcagatccatatttatctccagatactagaccttcaaaaacaaaatttaagaagccaaagccaccaaaatcgtctgttccccatattttggctgttttatgcaattttttagaagtatcatagatattttcgccatactcatcgtaaagaacatcatctgttaaggaaatttcatctagtttttcttgcgtaagatttttttctccgtcagcaatgactttttccaatcctttttcaggaacatccagtttttcacgttctgctggatgatcttgcagttcttctaattgatcaaatacatacgatttatccagctcgtaagcataacggaaggaatcttggcgtaaaacagtacgagtacttgtttcgccattcgcatctttatattcaatgtcttgcgtgctgaactttcctgctggtacgacaaaagtcagtatccatgcaaagatgactacaccaaaaataatgacatacgtatggggtgtcgataatttagtgaagtcacgtttcggttttcctgaagaatttgttttcttcaaatttatttcttcctttcttttctcagtaattttgatgaataaaaaatggataatcaaatgaattatacagtaaaaatgtcaattccacatgaataatttattagaaaatcacttttttctattttgctttttttctcatatgtatgactatttttttctttttccatttatattgagtattttatttctctgtttttccttaaaattctttttttatttttagattagcggaaatcccgtcctgattttttcattttataatcgtgaataaattgtatttcattgcaaaaaagcaaaaaataataataaatattcatctcatatctttcattttttgtatattttctttctattagaaaaaggaatcttcttcgacaattttgttatatcaggtaaacttcattgcaataatgataacaaatgtactataattacattgtaaagagttttggggaagactctttcatcaacgtgtattaagaggcaagaaaggatccatgcggattctttcttgtctctttttccgctattttttttctatctagcattgcatatttttgtagctcttttcttctcattgtgaaacaacttataaaaataacgtactttcaaaaaaaaaggctgacctctatagctaaacaaacttaaaataacaaaaaataaaaaacgattattactgcttttctttaaaaatcgttttctttgtttcaaacactccatatttacgtggaacaccgtttttttaaagaaactttggtcattatgtggaaaactattttcctcttgtttcctgaactagctgttttgctgtaaaatacaatacttgttgaagcaaaaaaatcgttgcaagagaggctgttccacagattgctggatctaaattcggcaaagtcaagactgcatcatgcagattggcatggttatccaaaactaaatcagcaaattcaaataatctcaaaccactgctatgctgggacttgatgcttcgtgacaaatcaaatccagtaacaatgatcaaaggatgtccattttctttgatccattgagccaactcaatgattgctggatttcttccttcattcgaaagaagtagaaaaatgtcttctggtttgacagaaagctcatcaataatcgcttgtcctgccccttctagcgtttcatagacacctccggctgggttttcaatcaatatacttggcacaaggtccggtgtttgatcccaaaattcaaatgctacaccacttagtgtgcggctagcatatatctgcaatctgccgccttgattgatttgtttcgcaatccaagttcctgcttgaaccatcaacggctcttctatccttaatttctcttccaattggtaataatagtcaaaataacataaactcatttttctctcccgcctagctatacttgacatgaatagaaacagctgcctaatctaaggaaatacataaaaaacagaagataaacagtaatacatgcggtctttgctgtttcaaacgcaaaaaaggtattgaacgaatacgcccaataccttgacatagcaaataaaacaacgtgcagaccatagaaaatctctacacaggggtagaattttccccttagattaggtacaataaataaggtcgatgcactgcattgactatggcaaaatgatcggtcagggtgtatgagtgtgactggtcattccctgattcttagcgccaactaagggtcagggagcctttttttattcagctgtttctatctgaactcattgtaagtaatctcttattcaagtgcaagtacgaaaacacaaaaaaacattggtatgatttttttacaaataaataacataaaaaaaggaatggcttgtccttatgtagcaagcattcctttttgaaaagattcttttaaataagtgaaaaaagttttttctcaccaattaaataaatctctcaactcaatattttgtccattattttatctttttttgcgtatacatactaaatattaccgtcttcttctcgctcttctgctttgttctggagaatctgtactagaaaaagtagtggcatgtctaccctttcttccgatccgagactttcttttcctataaggaatataaatgagcagatacaatacagcaaaaaataaggcaaatatgcaagcttcccaactacctaacgccagttcgatcatcaagctagcaactgcaatagacgctgcataccagataaaaatcaggaatctttctttttttctgaccattttgaacatgataaatagactaatgagcaatagtggtaacacaaatacccaattatttccttccatcagccacttgagtatatcaagtagcgactgcgcaatagcgactaattttcccatagtggacacacaccttttttataattaaaaaaattcgcctttttattctactatgaatcttctggattggctttcatttctcttatgtaatcattttcttttatgtaacttaaaaaaaaattaaaccattagcagaaaatttcctaaatatattcacgaaagtctttttctatctttcatttttcctcgtcttcattcacttagcgtcaaaaaataaaaacgacagttgcgcaaatgacgcacaagctgccgctttaatacccatttgatttttattctcagcaggtcacttatttccagttaatttcctgttcttagctctttgctcaactggataatatatgtgcttaacgatgcgccgatttccggatgatgaagtccatattcaatatttgtcttcatatatcctagcttatcgcctacgtcatatctttttcctttaaattctctcgcatagaccgcttctgtttggttaagggtctggagcgcatccgttagttgtatctcgttccctgctcctggttcttgagttgctaatatctcaaatattttgggggtcagcagataacgtccgataatggctaaattgcttggtgcttttccaagttcaggtttttctacaaaaccatttactctgcaacgtcccttttcgttatccgttttaggatcaataattccatatttagaggtttcattttctggtacacgcatgacggcaacagcagaagattgtgtttcttcataatccatcatcaattgttgagtcagtgggatatcatctttcatcaaatcatccccgagcatgacaacaaatggttcattccctatgaatgcttttgcttgaagcacggcatcccccagtcctcttggatgagattgacggatgaagtgaagattgacatgagtcgtttcttcaactaaagcgagtagttctgttttttccttttcccgcaaattgttttccaattcgatatttgcatcaaaatgatcttcgatgggtctcttttcttttcccgttacgatcaagatatcttcgattcccgaatccaatgcttcttccacaataaattggatcgttggcttatccacgattggaagcatttcttttgccatggcttttgttgccggcaaaaaacgtgttcctagcccagcggcaggaataactgcttttttgaccttcacttactgttcctcctaaacgacgcttacctgttaatcatctatttaacgaagagaaaattcattctccatttttccgtcacgtagcatgatttcttttgctgcttttttaatatcttctccattatacaaaacattatagatggtttgagtaattggcatctcaacccctagctgttgtgctagctcgactgctgcttttgtcgttgccacaccttcaacgaccattcccatgttttccaaaacttcttccagtttatgcccctgtcctagtaagttaccggcgcgccaattacgggaatgaacacttgtacaagtaacaatcaagtccccaacaccgctcaaaccgataaacgtcagcggattggcacccattgctacaccaagacgactaatttctgctaatccgcgagtcatgatggccgcttttgcatcgtctccgaaccctagcccatggatagcaccggcaccaatagcaatgatattttttaatgctgcgccagtttctacaccaatcacatcattatttgtataaatcctgaaataatcattcatgaataattcttgtacataagcagctgctttttgatcgatacttgcagctgtaatcgttgtaatatcatgaactgctacttcttccgcatgactagggccagataatacgacgattgcctgtcgtttttcttctggaatctcttcagccaaaacttctgagatccgtttatgcgtatcttgttctaggcctttacttgcatggataatgacgggcttagtattcattttaccaataagttcctgggcgactgaacggattgcttttgtcggaacgacaaacaaaatagcatctgcgtcatccactgcttctgccaattctttatatccgataatcgattctgggatcgtcaaatcgggtaaaaaatgttgatttgtatgatacgtattgatttcgtcaatctgttcaggtacatttccccaaatccggacatcatgcccgttttctgccaatgtctgtgctaaagcagtgccccatgatccaggaccaagaactgcgattttttgtttcatggatattcctccaaataaataattgataatttccattatagtatacatttcttaaagtttggactaatttccattgtttttaagtgtttgtttaattcttttatcgactttcacttgaaataatctattaaatgttgcaatagcgtacattttaatttttttctttttacacttgttatactttatttgtcactaagagaaaggaggtttgactatgtttccattaccattaccattgggaggctgggaagtttctcctaacaacccttaattgaagctacatacaagaagaggctgggacagaagcgtttaactccaagaagtaagaaggaattcacgaaaattgcttttcaaatttttgtgaatttcagcttatttccgaaggagttgcttctgcttccgccggttatacgtgtttagagcgtgagacaaaagtgttctttacttttgtcccacgctctttgcttaaatcaatacatggtagaaattttgataaaagtcgtatcctccttattccgagtaaatgatgtgacacgcagttatacatcaggcttattatctcttgatacacagtgttcaatcagctcaccctcaatattagattaaaaaacggcaaaatatgaaaaactattttgccgttttgtttctgtaatacttaggtcaaagtattgatttcacaaccgcttgataaacggtgttacagaagtagcttctatcacgacctcatcatcaacttattttttgccataaagagaaggccgtatctggtgcccaatgtgcggctgcaatatgcgcttgcaagcaacgatattgaataccattatatgtgactatgtctcctgcttgataaaaagtaccgactgtccaagaatttccttggccgttctcgtctagggttcttgctgtgacagactggcttagtaaagaaacacctgtccgattgactgcacgaacttgatagcgatacgcagtagaagctgttaaattttgatcttcaaatacagcggtttgtgaggtagcgatcttcttgccatctctgtatatttcataataaagtacttcttccaataagctattttcttgccataccaaacgaactgttgattgtgtcacatggttgatgctcaacccgtttggaatagaaggtgctggtaaagctgttgcttcttgcgtacggatattcaatctatcggaacgtgcagaaatatttcctgatggatcgaccgcttcaatcgtataagaataagtcgtttctggttgtaaacctgtatgtatataattcgtagttttgcttgttcctactaatcgattgttttcataaatattataatgtgacacacgaacgttatccgttgacgcagtccaagacaatgtgactgtcgtacttgttgctgttcctcgaaaattggtcggtttagaaggtttctctgtatctggttcttgttccgtaaacagattttgataagctttcgcaaatgattcattataagaaatgccagctgagtttaccccttcgtcccagttcacgctccaagtcatcaaaccttttaaaggtgtacgttctttttccatttgttcgaatacttgataaacaacggatggatcttgcacataaccgttggctgccgcatcgttatttgctggaatccccaaagccagacgatctgctggtatccgaatgtatccactctctccgttatgcaaggcttttgacataccatataagaaatcatattttcgactgtcattgttctgagcaatccattcgtctcccacgcttaatccgtcgcccgcctgattatatagttgtggtgcaataaaatcatactcattttctaatgcagtgatataaggtacatagcctcccgctgttctcaaataagggaattcaggtgccatagaaataataaagtgttttccttgctttttataatgatctcgtacgattttcaacgcttctgggatcacttgctggttatctcctgccgtaatggcgctttgttctaaatcaatgtctaaaccatcaaaaccataagtttctaccaaccgaatcacttcatctgcaaatgcttgttcttgtcctctgtgcaattcgatatgggaatcagctccgcctaaagaaatgataactgatcgtccttcttcattcagggcagccactttgcttctgaattcttcatcactcatattaaatggcttaaatgtagggattccttcgcctttcataaaagatactgcgatgacattgtaaaacggattgatctttcctaagtctgtctctgctggtttcccacctctatatcccgcaccttgctctggtacccagttatgataatatccaacagcaatttgcttttctgagatatccggcatcaatgccgcggaatcttgtgcagcatgtatagtttgtccacctccagcgaaacagccgattgctgccaatgacagccaaaaaatttttttcattcatcatacctcctagtatttggtaaatatattttattttaacaacatctgtttttcattttttgtatgttattacaacataaataaaaattgcttttaaagcatgagcactttttatcaaaaatagtacataattgacattttcgtccttagataacagccttgtgttatcttatattcataaaaaacgtatggaggtaacttacatgataaaacatgcttctttaattcgaaaactaagaaaagaacgtggactgacacaagctcaattaacagaggggctttctcagcgagggacattagctgcttttgaatctagaggaacaaaaatcagttttgaattgttagtggattaccttgaacggatgaatgttacacttgaagaatatcaatttttgctgaacaacaatactctcacaagtaaacaaaaactttctaattacctgatcacaacaaaatatttaacaaaagagcaagagaatgaactgctaaaagaatataaaaaaactgggaatatttattatcgcctgctatatacgcaacgtatactaattgatcaatatctgggaaaccgaaagctcactcgttcggaaactttgacagaagtttctattatcaaaaagtacttggaaggtatcgatacatggggacactatgaactttctattttttccaattgtttattcatattcgatgacgagtatatttatcattcttttcagcgtagtgtcacaaaaatgaaagcatatgtcgatactgctcattattccgaattattatcaaattttcttttgaacgggatacatctatcttttcatcgttcttctgtttttcttagaaaactatttttaggaggatggaaaaaagtaagtgaccgttataaacatacgttagacttagcccgttacaaagcattcactgctttagctctattagcagatggcaatgaacgagcactagaagaaattgacgaagcaatccatttctttgaatggctaggactagaggaagtgaaagaagagatcattgaattgagagattctcttttgaaaaaaactatacataaaaatgataaggctatttatcaatagtcattcttctagttttttatttttgttgcaataccatacaaaaaaataatatttaaataatacattttatactatcttacgaaaaggaaaccttttcttaaaatattttatctaactggaggaatcatcaaatgaaaaaaagtactttattgggattaggaatgttacttgctacaacaggaatcgccgctttgtcttctgtagatgtctcggctcatggctatgtttcacaacctatcagccgtggctatcaaggtgctctagatagtaggaataattggcaaagtgcttttgaaaagtatggtcgtatcatcaacgaaccacaatctttagaggcaccaaaaggattcccttcggctggacctgcaaatggtcggattgcttctgctaatggtgcagtaggtgactttgttttggataaacaaacagctacgttatggacaaaaaacaacttaactactggggcaaaccgattcacttggcatttcacagctgaccacgcaacgacgaaatggcactattacatgactaaaaatggttggaatccaaatgccccattgaatagaaatgacctggaattcattggtgaagtaaataatggtggtaattcgtctattactaatccgactcatacaatcaatattcctagcaatcgtctggggtatcatgtcattttagcagtttgggatgtagctgacacagataacgcattttataatgtaatcgatgtcaatgttcaaaatcgtaatgcattaactgacttggaaaacaactaaaaaataaagggagcagttgtcgctgctctctttattttttatattcttttcatccaatcgatcctaataatcaaactgacgatagtagcggcgtatctctaatggatgacaattcagctgttcgacatgtgcatcgatacgctgtgtcactgcatgcatcaataagaaagacaacacacgtccgcgatatttttcgctgataccttctactggatagtcttttgtatctatcaatgtataattactacaaatttttggcaaaagtttagctacacgttcagataacgctctctgttcatcttcgcctaaaaataaagtgactggggtcgtttcttcaacgatctctaacgtcccgtgaagaaactcggcagcatggatagatttcgatgggagccagctttgttcttcccaataacacatggcatatgaataaacagctccccattgattccctgctccgataaaataatgcatgctatcacgtcgatgcttttctgcaaatgataagccaaatgtatctgcttttttctctgcttcaactaaccctgttggcaaataatgttcgagctgttcatagtactctgagtaatcttcgaattccccatgcaaatacatcaatcgatctgctaccataaaaaatttgatttgttctgttccgggagctggataagtaaccacaaaatcgcatagttgagacaacttactctccgctttatcgataaatccaatcagtgtcgctcctactttcttgatttcttctactgctttcactacttcttgggttgtcccagtaacagaggacacgacgacaatagaatcttttgttaatcttttgttcccagtagtgtaatattctgcagcatgctgtacaaagacaggcaagttgcttttcccattcatataagtgacagcttgcatcgaagaagcatacgttccaccaattcctaaatagtagacagcatcgaatttttccgtataaagtttatcgatgattttttctacttgcggacgtaaagctagtgcaccttttattgctttgatttgttcttcttcattgaacttcaacatgatttccacctcttataatttacttttcaagactgtatcaaagtcttcaaagatctttttgttcaagtcgattcctttagctgctgcgattttataagcgaatagttgaaatggaacgacaagtgctaatatagacagatattcatcacattctattgctaatccaagtgttttctcgtctcttgctttttttgtggtaattgtgagagcctctccaacatactgactcatatatctccgcaacttttgtgaacgttccttattttcattgtccccttcaataaagaacagcaaatgggaagcatcagcctctagatatgggccatgcatgtaagcttctaactcaaatccttgtgacgggacacggattgtttccgtcaatttcgtttctgcttctttcgctgttccccagtttggaccatagccaatagtgatgaagcgttgtgttaaacgaaacaaactttgatactcatcaaaaaattcttccgttttttgaataatcactggtaaatgatcgattattttttgtaactgttgcatgtagttttgttctatttctttgctgatattatttttacttatcccaattcctagccctaagagtagtaactgtaagacagtagcagaatagccttttgtaacgaagccaactgtttctatcccagcacctaaatcaataatctgtgtagcttctaaagcaagtggactttgtacgtcatttgtgacagcaataatcggtatttcttgtttttggatcatttttactgcttcaacagtagaagcacttttcccactttgtgacacagcaatcacagtatcgattgatggagaaagttttccataatgagcaaaatgaaaaggttcttgaatatcgacagttagctcgccataagattccaatgccggcttcgctgctaaacaagcgttgtaagaagaacccgttgctagcatcagcagattcgttgtttttttcatttgttttcttgtcgaaaaatcattctttttcaagatcgtacttagtacttccttttcttcataaatataatcttgcatcgtaaccattttctctgctccttttctaaaaaatccctatccacgaaccaaaaatcccaaagaaagctaatccgatcaagatcgtcaatggttttacttcttttttcaatagataaaacactacaccaaatgcacccagacataagatatttgggacaatatcatcaaaaatactttgaacagtcacagcattttctcctgaaccgatttttaaagggatattgatagtaatcatcgtggcagtcattgctcccacgaccatcaacccaatgatagacgcgcctaatgtcaaactttccatcatcccgtttgcctgaatctttttcaaaaaacccgttcctaagcgataaccccaacctgttgctagatagcggaacagaatgtgcggaatattgaaaatcaaaatgaacaagataggtcctaaaatatttccttgcatagctaaagaggtgcccacacctgtggcaatcaatcgcaaagttccccaaaagaaagaatcccctaaccctgcaagtggtcccatcaaagatgttttgatactgtcgattgcggtcacatcaaattcaggatcatccttattttcttcctccattgcagccgtgattcctaaaatcaatgtaacgatatgtggggtcgtgttgaaaaactctagatgccgtttcaaagctgctgccatttcttctttcgactgatataactttttcaaaatcggaatcattgcgtaaacataagccatattcatctgtcgttcatagttccaagaaaactccatttgaaaagaatgccagaatacatgattcagttcttttttcgttattttgctgtttttactctcagaattcttcatcttcttcgacctcccctgcagtggtttgaagtggcaattgacggacattcatgatattgactaccacaacggctaaaattgcaccaaaaatagctactccggtcacaggaatctttaagtaagaagctatagcgaaacctaagaaaaagtatggcgcaacttgtttgttaatcagcaatcgagcgagcatcgcgaaaccaagagctggaatcaaccctgtagctactgacaagccattctgaacgaagtcaggaatcttattgagtagatttccgatcgtattgcttcccaccatatacgaaaccattaccacaacaccaagcatcaaagaaagaccgaaaccggcaagcaagtgcatatgctcgactcctttatagtttccttcttctgcataactgtccgctttatggttcataattggaatcaaaagacctaagtaaatatttttcaatatcaatgtcaacgtagcaattggtaaacctagtaaaagtgccgtttccgtaccagctccagctgtgatagcaaaagccgtgcctaaaattcctccggtcaccacatcaggggggatcgaagcacctactgagaatgatccgataaatgctaactccaaagtggcacccatgacgatcccagtttttacatcacccaacacgattcctgtaaacagtcccgtcacaattggacgagaaagcagtgatgtccctaatgcatattctgattgtgcgataaatgcaacgatacctaataagactgcttgtacaatcattgagtttcttcctttcttacaaaacttcccttacgtccacttttttatctgccggtacttgacggatctccacttctatttgtttgtcaatcaatcttttcaatcgttcctcctcttctggtaaaatattcaccgcttttccaatactgcgagtaccaggtttcgccttgatccctcctaagttgatggttttgatttctggatacgcttctgccagcttatatgcgtcctcgattgattccactacaatgaatagcttatatttatctgtcacaccgcttttcaatgcggcaatcgagtcatcaatggatttgattactagtttgactccttgcggcttggctaatttgattgttgtctttcgtatctcattagtaggcacatcatcattggcaatcaaaatacaatctgcgcctattgtttgtgtccaagaaaaagcgacttgtccgtgtaataaccgatggtcaactcttgtcaatacaatcattcttcttcctcctaaaattcgtcttcttctattttttgattgatccgttcgttacaaaactggatcattttttttgaatcagttagcacctgttggatcaaaacagttgtctctacttcagcgtccaaccgagatactagctcaatcaagagtggcaaattcaatccggcaacaagatagacatgatcctgattgatatattgtaagaattcattgttgacacttccgccaaaaagatccgtcagaacaatgatttctttatctttgtacctcataaacagctgacttactgattccgttaaatcaaaattctcatcagtatagcagtccaatgcagtaatagaatgatttttcccatagattagctctaatgaatctagtatccctgaagcaaattttccatgggaagctaagataatttctctgtccactttttcatctcctctttttacttacacatactaaaaagcaagttgcgtgccaaagttagtggccgcaacttgcgtatgttcaaaattcttcttctatcgagagtaactctgtactttcactcaaaatatcacagatataggcaatctcagaatgagggatcatgacactataatgctcttcaatgacactaaacgcagatttaatagcagatacctcttctttttgacactgttcccatttctctaatccttgataggtttcaattggcatttgtcgaatcaaacgttcgattagacagctcacatggacatataacgctagttttttgggattactgattcttcgattcaactgcacctctaattctcgcataaaatgatcgatttcctccatcaccttttctgtatctagaatagtcacagagtccagtactttctccaatgaaaaattgcgaatgatgttctggttgaatgtttccttatctgaaacattcatagcagaatccaaccattctgctagtacagacatcttctctcctgagatgaggtcttctaatgaaagatagtcgatatcggtgatagcaggatctgcggtacctatgatccctacgatttcgtatatggaaaacaatggttccctgtttttcttatcttttaatcgctgatattcatatgggatgattttcaactgacaagtcgtaggcaaacttttctctagcagttcacttaggtgagccgccgtgccgattccagtgaagcaggtagtaatgagtgctttgggtttattttcttgtggatagaggagccgccattctggttggatttgacgaacggcctcttctgctatttcttctaaagctgcattttttttcaagcattcccctactgtgatggctaaaggtgtcgtcacattattcaaaatcaaaagtggtacagataattgttttttaaaaaactgatggatttctttcagagatcccatatctactaatatgatcaacccatttgaaacatcgctgttttcgcaataatccacgatttctgcagcaatctgctgtggtgtgacatctagcgtcatatcaaatgattcaaatagatcttcttgtaataaacgattgaccacatttgccatactgctggcagttgcataaccgtgcgcagcaatcattgcttttggcagttgtttttcttttgaccattttgctttttttagatagatcgtcagtaaaatccgatccatactagtgacttcaatatctaatttaatcttactcagttccaagattcgctggacataatgataactagatggataagattgagaaacctgtttttctaattctttgattagttggataatcgcatgttcttccggtaaccatttgacagtgcttcgctgataaagatagtaactcaaggcatagacactgtttccatcgaacttgatttgataggcagactccatttgtcgaaaggtctcacggatagattgagtccaataaaccaacagctcgtgtttttcttgtctactggtctcaaatagcaaaaaatcaaataattggatcacttcttgttttagttttccttcgcaagaatatagaagacacttattttttttgaaatcaagcaggatttgctcaaaacttttaacgattcgttgctgttctggttgttgcttttccatcaattgttctaaggtctggtcttgcgtgatatagattccttgctgtgctgtatttttggtaatgggctcagcgagtagttctttttgcaaatgatggatggtgacatggatctccgactgttcacgttgttcagcatacgcttttgctgctgaaactttgacaatatttttcagctctcctatgtttccagataatttttgacctgctagaagtgacaaaactgggccactgactgacaaagggcttcccatttttctttgttcctcgataaaaaaagagtaaaccaattctagccgttcatttcgactacgctgattgagcgcaggcagttcgattcggataggtattcttcgaatgaaagtggttaagaaatgactagtggtctcttctgtcgtggcaaaaaaaagacgtgttttgatccgccgtgacaaattaggttctcccatacgataaatcacaccttgatcaagataggtgaatagtttttcctgcccttctggtgttaagcgatgtacctcgtctaaaaacaagattccaccatctgctgcttcgaaagccccttttttattttcttctgctccagtgtaagctcctttgacgtgaccaaacaaattgctagtcaacagttcaggattatctgcatattgtgcacaattgaaagtgatgaatggtgcagagtcctctagtaaatcatgaagcagacaatactgatagactaaatggactaaataacttttacctgtgccgctttcacctgtgatcaaaagtggcagtccgccatctggatagtaaagagctgttttgatttgttcgatactttctttcaaactggcgtcgtgtccgatcataaaagagaataaatcttttggttgtgcgaaaaaaggctgttcttctttaagatcattgatagaaaaataaaaattcgtacgtaacttaaaaaattgtttttcaaaagcttctttgtggaaataaaccactggacgagaattgattttgactagtagtttctcttcattcaactggttcaaataatgactgactgtgtttctttttaccccaaaatgttcagccaatctttttgctgtaaagacctcgttcatatggttgagatcgaaaaaggctgtctggttctctaagtagcataaaatttcgtgttttaacaacttatccacccctactccatcatagaaaacggattcattttgtcaataaaatctttaataaagggttgaaaaatatgtcttgttatagacagcagctcacttatcccttataatttttattctaaaaaagaacagttccttccggtttttatactgggatttccaaacaataaagaaagaacaaggaggctatgactattcaatgaaatcggataaatctaaaaagaggaagtatacttcttggaaaacttttcgcgaaatcatcggatcttatctcgctgtggttgtgtttttacctttgctttatatggctatgacagaacaaacccgttttattgatgtagatacgcaatatatagccgaaacaggatttttatttatctttatcttgatttttgcgttctataaatccttccacacaaaataggaggcacagctctcaatttttctgtctgctttttgttattacaaatccttatatctggtataacaacaatttattggcgtaacgaggaaaaacgagttatgatgctttcagagagtaaagaggtactgttgtcaccatcctttttattgattacgtacaccactcttagttttttcccattgattaagaaaacaaggtagaaacatcactgttcctgccttgttttctttttcgtgtgctgttttgatatcaaaatcgcaaacgactttctacatagcgatattgataatgagaggttgtattcgttacaccaaacttaatagaagcgtttcttcctactccgatgttcacccctgcattccaagttgttgaaccattattgaagaagtcgccatttacaatgtaaaaaatacggttagcatcttctaaatgaacataaacagttccaccaaattgtttcgacaaaccattatatccgcggatcatttcaactcgtacgattcttttgatagccctaaaatttccactttcactggtctcccaataaaagcgcatcgtgggtctataactagcattgactgtgaaagattgcgataatgttctgtatgttgctcttgctgtacgtgcttgtcttgcactttcatctgtgaatccaagctcttgttgtgcttggataatagggatgccgttttcttttgctacttctcgcaccatttcatcaaaagtgagtacgggacttatgtttatctctttcttttcatttgatatgtcgatcaacgatgcatccacttctacagcaaacacaggctgtccgatattacttaccccccctaaagctgccacacataataaaccaatcaacgattttttcattctcatatcccttctttcaacattaattagctttcccacaaacaatttgttacaataactttacagcataaaaaggaaacgatttcaacaacttttaaaaaaggagaataaactatgaaaacaaagcttttattagatttaataacatcgttacttttaattttttcgcaaaaaataacgatggtttttatgaaaaatgaagcttcgccctctccattttatgagattttattcattactaagatcatttgctttatactcgctgttttttacttaaatcatggaatcactacttttttattttcaaaaaataaatagcgctccattgatgattctgtacctgatccaccttttgcacacgattcatttataaaaaatcggacaaaatagacgtttggaggaatgaagagaccgggatgaatttcccgttctctttctttttttctaaaaaatattctattcaatctctaaaatctcttcataataaaactttcatttatgaaaaggcttgttctcttttcattctaaatttcctaagctacaatgtggtagtacttgttttttcaactgtagacaaataaataataggaggaatcatatgattcagttattacgttatgcaaaagattatcgtaagcaaatcattttgggtccgttcttcaagtttcttgaggctgtcttcgaacttgtcctacctttaatgatggcttccttgatcgataatggattaaaaatgaatgaccgaggaaaaatcattgaaatgggcttatggatggtcgctatgtctgtgattggtctgatttgtgctatcatttgccaatactacgcttcaatagcttcacaaggatttggtacagagttgcgaaatcagctgatcaaaaaaatcaatactttctctcacaacgagttgaatcattttggaacagataccttgatcactcgaatgacaaacgacatcaatcagcttcaactagctttagcaatggtcattcgtttattgattagagcaccatttttaagcatcggttcagtagtcatggcttttgtgatcgactgggaagtaggtctgtttttcttagcattattgcctattttctccatcatcttattttttatcatcagaaaaactgttcctctctatcaaaaagtgcaagaaaaactagaccagctcaatgaacacgtcagccagaatcttagcggcgttcgtgtcatacgtgcatttgcacagacaaaaaaagaaacagaaaagtttgataaaagcacaaatgatctagcgaacaattatttacgtgtttccaatatctctgcccttttatcacctgctacgaccttgattatgaatgtcggaatcatttgtttgctaacagtcggcgggatcaaagtaaacattgggagtttgcaacaaggacaagttcttgctttgatcaattatatgaatcaaatgcttttggcactgatcgttgtttcaaacctcgtcgtgatcttcacacgtgccgaagcttcaggtaatcgagtaaaagaggttctagacacagagaattcgattcttgaagccgagatcagtactactcccgatttttcttctgaatcgattctcgcttttgatcacgttgacttccgttatactcctgattctgggctttctcttcaagggattacatttcagctgaagcgaaatacggtccttggaatcattggtccaacgggaagcgggaaaacgactttgactcaattgattccgcgcttctatgatgtcagttccggtacagtcataatggatggaatggacgttcgttcttggcagctggatcatcttcgtcagcaaatcgcccttgttccccaaacttccgtgttatttactgggactattcgtgaaaaccttcaatggggtaagcaagatgccacagaagatgagtgttgggaagccctgaaaatcgctcaggcagaagaatttgtacgtcagcttccaaatggtttagatacaaaagtcatggaaaacggaaaaaatttctccggcggtcaaaaacagcgactaacgattgcaagagctttgattgccaagccagaattactgattttagatgactctttgagtgcgttggattatcagactgacttggatttgcgtaaggcgctgcagacttatcttggcagtacagtgatcattatctcccaacgtgtccgctccattcaagaagcccaccatatcttagtgatggatcaaggaaagatcgctgctcaaggtacgcatgaagaattacttgctcaatcagcggaatatcaggaaatcgtcgcatcacaggaggaagaatagttatgaaagtaaaaaaattatccttgcagacactccgtcgcttcatcccttatcttactgcttatgcgaaagacatttggctagctgtattactagggatcatcaacgggatcgcaacagttgtgatgacgttacaaattggccaaagtatcgatcaaatgatcggagaaggacaagttcgcttcaatcgactattccatttactgattctgttcggtgggatcgttttgatcaacgtagtcagtcaatggctcatccaagtattaagcaatcggttagcttacttgtccgttgcaacattaagaaaagatgcttttgctcaactgaatcgattgccacttcgttattatgatcaaaattctcatggaaatatcgtcagtcgatttacaaatgatatggacaacatttctattgcgatttctgctgccttcaatcaattgttttccggagttgcgatcatccttctttcgtttatttttatgatgcgtctaagtccacttctgacattggtcgttctttgttccacaccgattattttccttgtgagttggatcgttgctcgtgcttcgcaaacaaatttcgatagacagcaaagaatcattggggagatctcgggctttgtgaccgaacgaatcggtaatcagaaaatcgtgaaagcttttcagcaagaagaagctagtcaacagcaatttgaactgctaaatgctgatctatatcaaaaaggacaacgggcacaattttcttcttccttgacaaacccgtcttctcgttttgtagatcaccttgcttatttatcgattggtttagttggcggcctattggcattgaagagtggttcgtcaatcactgttggtgtgatttccagttttacgatctactcaagtcagttttctaaaccatttatcgaactttctggaatcacgacacaactgcaaaccgctttttctggtctagaacgagcatttgatttgatcgatcaaccagaagaaaagcctgatttgccagatgcctatgccttggaacccaaaaatatcaaaggaaaagtctcttttgatcatgtttctttttcttatgaccccaaacagcgtttgatcgaagatttcaattttactgcttatccaggtcaaaccattgctatagtaggaaaaacaggggccggaaaatccacacttgttaatttgctgatgcgtttttatgacacaacaaaaggaacgattacaatcgatgaccatgacatccgctctatccaacgtgatacattacgtaaaagttttggaatggtgttacaagatacttggctatttgacagtacattgcgagaaaatcttcgttttgggaatccggaagcaagtgacgtagaaatcaatgatgccctaaaagcctcttatatgtatgaatttgttgaacgtttgccggaaaaattagatactaagattggcggtcaagggttaaagatatcagatggccaacgccaactgttgacgattgctcgaacgatgatcagtaatccgcctatgttgatcttagatgaagctaccagctcagtcgatacattgacagagaaaaaaatccaacaagctttcttagcaatgatggagggaaaaaccagttttgttattgcccatcgcctgtccacaatcaaaaatgcggaccagatattagtgatggatcagggagccattgtcgaaatgggcacccatgatgagttgcttcaaaaagatggttattaccgacggctctatcaagcacaattcacagcacaataaaaacaagcagtcttctgggatgggaagactgcttgttttttatttagcgtggatcgctaaacttcttaaaatttttttgtaaggaacactacgtcctacgtaataaatggcaattgattgaatcggtaaccatatcactgtttttaacaggcggggcgcccaaacgacccagctgaacaatggcacatggtacatcaacgcaagccataatggtgtcaaaaataagtttatgatcagcgtgacactaagcgtagccaaaatggcatttttccaagtgatttcttttcgatagaaaaagaatccgtagattgctccttcaataaatgcattcaatgtaaatccaataaaaaatgcagatttcgagaagagagccattcctactaaatcagctaaaactgcacctatccctgaccaaaaaggaccaaaaagaatgcccatgatcacttgtggaataaatgtgacactgattttaataaatggggtctcgattgctaccagacgggacaacgtgaccatcaatgcaatcagtaagcccataatagcaatcatgcgtgcgtctaaccggtgtttcttcatttttagcatctcctttaagagctgctacatcgtatcatgcagcgaatgcgaaaataaaaccgcgaacattacgtccttcgtccaagaggcaacatcccatcctcttagcacttaacgctttattttctactctgtattatttttgggatcttttcccacagaaactatagcatattttcacatttactgcaaacacgaaaaactaatattattggttatattatacaatacgttcgtattatatcgcatattctcagttcgtttagcttttatagctacatataggcgaacattaaacgttatttttctatacacttatccatcaaaatgaaagtggacgtttgtctatttcatggacgattcttcgaaaatctaggaagccggcttccagtcctcttagcagcacctcagctgttccgatattcgtagccaacggaatctcataaacatcagataaacggataagtgctgttacatctggttcatgcggctgtgcagctagggggtctcgaagaaaaatcaccaaatctaactggtcctccgagatcattgctccaatttgctgatctccgcctaacggtccggatttaaaccgatgaatgggcaatccggtcgcttccgtgatccgttgtccagtcgtcccggtagcaaaaagttcatgtttttccaatattgttttatacgctgttgctaatttcaccatcataggtttttttcggtcatgagcgatcaaagcgattttcataagagacactccttttgatatggttaacatacttatttactccagtgtatcagtttttatttcttatggatatttattgaagcttaaaactagcacattgacaaaaaaaagaaaaaattcttgttcaacatgacattgaacttagttaacgctttcatttatactttaatcagttaataaaactaaaaaagaaagtgtggaacgtattatggtagaaatggctctgaaaaacgtatataaaaaatatgataatgcagaaaattattctgtgactgattttaatctatcaatcaaagaccgtgaatttatcgtttttgttggtccttccggttgtggaaagtcaactactttgcgaatgattgcgggactggaagatatctctgaaggagaactaaatattggcggaaaagtcatgaatgacgtggcacctaaagaccgtgatattgccatggttttccaaaactatgcattgtatcctcacatgactgtttatgataatatggcttttggtttgaaattacgtaaatatgataaagcagacattaaaaagcgtgtggacaatgcagcagagatcctcggactgacagaatacttgaaacgaaaaccagctgctttatctggtggacaaagacaacgtgtagcattaggacgtgcaatcgttcgggatgccaaagtcttcttgatggatgaaccattgtcaaacttagatgctaaattacgtgtagccatgcgtgctgagattgccaaacttcaccaacgtcttgaaacaacgacgatctatgttactcatgatcagacagaagcgatgactatggctgaccgaatcgttatcatgaaagacggatttatccagcaaatcggtacaccgaaagaagtttatgatacaccagtcaatatgttcgttgccggctttattggatctcctgccatgaacttctttaatgtgacattgaaaaacggtgtcatcacagatggacatgggcttaagcttcgtattcctgaagggaaaaacaaagtattagtcgaaaaaggttatgaaggaaaagaagtcatcttcggcattcgtccagaagacatccacagtgaacaagtagcccttgaagcttcacctgaagccgtagtgaaatcagaagttgtcgtttccgaattacttggtgctgaaacgatgctttacacaaaaactggttctactgagttcatctcaaaagtagatgcaagagatttccataaaccaggtgaaatggttgaccttgccttcaacatcaataaagggcacttctttgataaagaaaccgaacaagtcatcaaacttccctaatctgcccccttcagagctacgccagaaaatagtggtgtagctctttttaggacaaaaaattctcatcttagcggatttattatccgttagcagatgagagtttttctttgatagatcattagtatgtcgttttcttcgcgtacccttgaatcgattctttccgatttcctttttttgctgccgtaaataccgggatatcaaagtatttgctgagtgttcctgctataaaataagcaatattataatcaaccaaactgtggatgagtccaccaattcccatcaagatgaacactgtataaaaatatccttgagagtaatacgtgtcaggcatattaccgatgaagtaaaagatgctgactactagcatttctactaaagaatgaatcacacctatcacaaaattgaacccttggaaacgccaattagtaaaagtaaactgtccattctttaaaacgatactcggatgcttttgcaagtaccatgccccgatcaatgcaaatacaagatgtgacaatgcgcgcaatgcaatgataactggtgttgtcaaaaagaaaccgaatgtcgtacctagtgcaacagccactgcaactcctggtgtaaaaaacatcgcaataaataatggtacatgagacgctaatgtaaaagaagcaggtgggatcatgattttaggcataaccattgggataatgacccccatcccaatcaataaagcagaaatcgttagttttcgaactgaattttttctcattttttccctctcctaatatgtcttgacacataaatgtcgacttagtataactcacttatcaataactgtcaagacacatattcttttctaaatccatacaaaatgagtgtgagtatccagtataagaattttttgatcaagagacaaaaataggagatgtgacaaaatttgtgtcacatctccttgttcataatgggaatcaaaagcttgcctttgcggaaataagaccaaccaaatcaaaaataggagaagcaattttcgtaaatttcttcttatttcttgaagctgatcacttctgtcacaacatctttttttactgcttattttctgacatcgcattgcttaatgcggcaaattcttgtaatgacaacgtctctccacgacgttttggatcgattccagccgtttccaagctttttgctaaccatgcttttgtctgatcatctttgccatacgaatgctgcaaattattccaaagcgtttttcttctttgctgaaatgcagcttttgtcaatcggaaaaatgctttttcgtccgtcacttctactgccggtgtatctcttcttgtcagtttcaaaatcgctgaatctacatttggctgagggacaaatactgtttttggtacgatgaaggctaaactggcttccatataatattgaacagcaatcgataatgaaccgtatgctttcgttcctggttcagcagagattcgatcagctacttctttttgcatcatgacgactaattcatccacgaccaaatccgattcaagaaaatgcatcatgatgggcgtcgtaatataataaggtaaattcgccacgacttttaacggaagctcttcatgaaatgtttctcttacggctgttgataaatccgtcttcagaatatcttgatgtatgatggtcacattgtcatagggttgcatcgtatcagccaatacagggatcaaacgatcatcaatctcaaatgctacgacttgctttgcatgcatcgctaattgttctgtcaatgcgccgattcctggcccaacttcgatcacgttcgttcgttcatctatttgcgcagtttctacgatttttcttaaaatatttggttcagtgagaaaattttgtcctaaactttttttaaatgaaaaaccatgtttcaataaaatctcttttgttctagagggtgtcgcgatttcacgatattcactcatgttgttcctccactattttcattgcttgtgcgagctctttcggcgtgatacgaaacatcttcaaacgtttttccaattgtttgccgttcgtataaccgatacgcaactcatcacctagtttttctcgtttttcttttgcttgtgctccagctattaaaccatagtctaaaaggtcttgtctagtgatttcagaaacagccgtttgggaaatgtctggcgtcacaacttttttcaatgcttctaaaatagcagcatcacttgcatgttcaacaccaagacttccctttttctttggtttagcttgtgtacgcggcaaaaaagcatgttttgcctgaggaacagcttccataatgatttttcttattttttctcctgaaaaatcagggtcggtaaaaacgatcacccctcgagtctcttgggcatgttcaatttgcatcaggatatcttcattgatagcagaaccgatcgtttctatcgtatctgcatcaactacttcccgcagccttcttgtatcgtcttttccttcaacgactataatctcttggatcctcatcttatccatgttcgcttagaccaaataatcggtgcgcatttgtccatgtttgggcagccacttcttctattggcagattccgaagttcagcaatcttttctactgtataacgagtatagcctggttcatttcgctttcctctaaaaggaactggtgccagataaggggcatctgtttccactagtaatcgttcgattggtacatttgctgcagcctcttggacatctaatgcttttttgaaagtgacgacaccgctaaatgaaatatgcattcctaaatcaagaaatcgttttgcccattcataatcaccgctgaaactatgcatgattccaccgatatctcgaacatcttcttcttttaggatttgatacgtgtcttcaagtgcttctctagtatggatactgattggaaggttcatttcttttgcgatagcaatctgtctgcgaaatactttatcttggacttctttcgggtcttccatccaatgataatccaagccaatttcccctaatgctacaacctttggcaaagtcaattgttcttgtaatttattttcgatttctttcgtataactgccagcctctgtcggatgccagccgataatactgtatatatttggatagtcatggcttaattgcaaagacttttcaatcgttggcgtatcgaagcccacgaccgccattttcgttacccccatttcttgtgctcgctgaatcgtttctggaatatcttcattgaactgttccgcatttaaatgggtatgagaatcaaatatcatgtttatcgctccttttcattcttactttagcacattagcactgcttgcagaagtagcaaaaatcaaaatagaagaacttgttttgttgaaacagaaaaagcacgaagatccagaggacttagttcgtactttttctatctgttgttgaaatattttactcttctgagcgttttttctttttttgataatagactgggataccaatcaaggtaacacctataccgatcaatgctaatttcgtttgcgtcatcatcgtcatacctaaaatgaaaatagcaccgagaatcgcaataatcggaacgattggataaagtggtactttatatgggcgtggcaattccggcgatttttttcttaaaataaagacaccgataaaaatcagtaaactgaatagccacatcacaaaaatcaacatgtcggttaaaaagtcgaaagaaccaaggctcatcataatacaagctactgctaactggaaaatcgcaggaacataaggtaccgtaaatttctttgaaagctttgtcagctgtttgctgaaaggtagctcgtcttccaaagccatcgcataaggcacacgaatcccagttaaggtatacccattcaatgccccgtataccgaaatcaaaatcccaatagtgaccagttttccgccgatttctccaaaaatgacgtctgatgcttcagaagctgcgttcaaattaccggcaagatgatcaatcggcagagttttcaagaaaacaaaattgatcaataaataaacgacagtgacaaaactcagcccaagtataatcgctttaggcaaatctttttccggccgtttcatttcaccagccattgcgccgacgcctaaccagccgtcataagcaaacaatgttgctagcaacgcactgctcaagccttcgacaaaagtaacctcttttccagcttcgattggaaatagctggacagttccttgtcctggtgtcaataatccccatacgacaatcacggcaattggtatcaatttaacaatcagcgtcactgattgtacagacgcaccgacttttgttcctaataaattcaatcctgtcacagaaacagcggtaatcactgcaatcaacaaaaggtagtcggtagataattgtaataagttcgtcaattgtgtcgcaaagataatcgataatgcagcaatattagcggggaaataaatcaagctttgcgcccatcctaataaaaagctgggcagctttccataagctgcttcaatatatttgacagctccaccagtttctgggatcgctgtagctaattcagccactgtcaatccagcacagatcgttaagaaaccacccaaaagccaagctagtaatgtcaaacttgtagactgcgtgcttgcagtaacagcagcggttttaaagaagacccctgcgccgatcacggttcccataacggtagctaatgcgccaaacagattgatttctcgttttagtttgcctttcattcccatcctctttcttctttgaaatttggtataattttcagtataactgagaatattttaatttaccattcttttttctccactttcaatgaaaaactccctcttaagacggatgtatttcctctttattttgcgtatactaaacctaccttttccacgaaggaggaacagtttatggattttaagcgttcttatccgaaattagcagattatttatccaaccgaatcgatttttctcgtaaagaacagcagcagtcccgttggcattggttcacgttgattttatttggattattgaccattgcgacgttatcacaaaaattgatattgctgacggtgttcatcgcaatcgttgcattgatcaaaggccccgtgatgattttgtgggggatgttgtattcctttctagtggggctattcccacctatcggtattttgctttcagcgattttctttttattgaacatcggaacatttacaaagaactggcggatgaccttagtagggatctatttttatttttatcccttcggagtgatggcacttcgtgaagtcatgcattggaataatcattggttttcagctggtgccttgcttttaggattgatcttgcttcatgtgatgttgacgaaactgtatcagcgttatggtattggaagaacgattttctggtatgtcttttcgattccatttgcactgcttactgcgctcttaccaagccgtttgaagacaaaaataaaaggttaccataaaatcaaataatcggatttttacaaaataaagaaaacaatcatcgaggtcaaaatcgatgattgttttctttattttaaatactattagtagatgtcaacaaattattgctttcaaaatccttggatgtaagagacaataaaataaaaaggagcgccagatgaaccaattaaaaaccgcccgtccacttatcattatgttgcttctttctgtctttacgattcctatcagcctttttcttaattggcagacagaggaaaggagcacaaatattttattcaactattcgcagccactttttcttttgtttttaggaagctgcagattccatcggtgggtaaagctcgtccttctttttctaggatacaatttatatggttatatgtgtctttattatatgattggcttccataatcaccattggggcaattgacaggaattaaaaaaactcgcaagcaacattgtcttgcgagtttttcttatgattttatgcgatctctgagccattcggcatggattttggtgcttcaatcacttgtaaagagccatctggtgcttctgcggaaaggatcattccttgactgatttgtccacgcatctttcgtggtttcagatttgcgacgatcactacttttttcccaatcagttcgcttggatcaggatagaattcagcgattcctgacaaaatttgacgatcttggctgtctccagcatctagtcggaattgcaacaacttatctgccccttctactttttggcagttgatgacttctgctacttttagttcaactttttcaaatacatcaaatttgatttgtttttctttcgttgaaacaagttctgtttcttctggatcccatttgactgtatcttcgtttgtttgagtaccttcagacattttttcttggataaaagcaacttcttcttccatatccaaacgtgggaagattggtgtaccttttgcaactacttttgttcctgaagggaattcgccaaagtgcaatccttcaagattcatcgtttcagggtccaaccctagttgattgaagatcttctctggcgtttctgtcatgatcggttgaagtaaaattgcggcgatacgcaaggattcagctaaatggatcatgacactattcaattcagctttcttttcttcgtcttttgctaatacccatggttctgtttcgtcaatgtatttgtttgcacgagaaatcagcacccagatttcagctaacgctgtattgaattccattttttccattgcatcatggtaacgtccgacaacgttagcagccgtcgtagacagttcactgtcaaatggagtgacaagtgaggcataatcaggaacgagtccatcacaatatttattgatcatagcgatcgtacgattcaataagttccctagatcatttgccagatcataattgacacgagaaacaaaatcttctggcgtaaagacgccatctgacccaaatggcacagcacgaagcaaataataacggagtgcatctaaaccataacgttccacaagcatttcaggataaacgacatttccttttgatttagacatttttccatctttcatcaataaccagccatgaccaaatacttttttaggtagaggcaaatcaagagccatcagcatgattggccaatagatcgtatggaagcgaacgatttctttaccgaccatctgaacatctgcaggccagtatttttcgaatagactttcatcctcggacccgtagcctagtgcagtgatgtaattggacaatgcatcgatccatacatacaccacatgtttcggatcactcttgactggtaccccccaagtaaaggttgttcttgaaactgcaagatcttctaatcctggtttgataaagttgttgatcatttcatttttacgagattctggttggatgaattcaggatgttcttcatagtattccaacagacgatctgcgtatttgctcatgcggaagaagtaagattcttcttttaccaattctacttcgtgtccgcttggcgctttaccgccgatcacattgccttcatcatctttgtacacttctgcaagttgtgtttccgtaaagaattcttcgtcagaaacagagtaccagccttcatattcacctaagtaaatgtctccctgttctaataaacgatcaaatattttttgaacagctgctttatggtaatcatctgtcgtacgaatgaatttgtcataactgatatcaagcgttttccataattttttgacatcagccgccattttatctacgtattcttgcggttttacacctaattcttctgcttttgtttcgattttttgaccatgttcatccactccagtgagataaaacacatcaaagcccatcaaccgtttataacgagcaattgcgtcacatgcaatcgtagtatatgagttgccgatatgaagtttgccgcttggataatagattggcgtagtgatataaaaagtttccttttctgccacggggctcttcctcctttatcgcatgatgcgaattcgtttccttgctagtataccataaaaaaagcaagctgttagctttttttcaaaatgaaaaagtctggataaatgacttcttctctatgatgaatccctccttcaaaaggaaggacagagggaataaatgctatttttcatcttgtttcatgtttagttggagacggctttttatttctcttctgactcgtggtataataaagactatctattttagtaagggactggaacgatcatgcagaagaaacatcttttttttacacttagtattgcttttctttcattagcacatttgatattcagctatttttatattcgtatgtatggttattttaaccttcatgggcatttgaacagtttcatgacagtcgcatggcttttacgttttgtcattgacgcatatatcgttatttgcggcttctttgccgttcgtgaagagcggtataaagtattaccgttttatctgcttttctttttattcaatctagtactcccatttatttttcatatttaagggagaaccaaggatttttcaagtaaatccttggttttttttcagagtctgctacaataaggtaaaaagtacttttaatgtcaacggaggtggtctgatgaaccgatttgcttctaaagaagaagaaaaattatattatgaacatgaagcaagtgaagaagattttcttaactggtatcaaaaacaggaacgtccagaatatgacaagccctctttgactgtcgatatcgtactgatgtgctataacaaagaagaagatcagctgaaagtattgctgatccaacgaaaagggcatccttatcgaaattcatgggcattacctggtggttttgtccaaaaggatgagtcaactggagaaagtgtcttaagagaaacaaaagaagaaactggtgtagttatctctaaagaaaacattgaacaactgcatacattcagtacgcctaatcgagatccgcgaggttgggtcgtcacagtcagctacttagcttttattggagaagaaccgctgatcgccggagatgatgctaaagaagtacgctggttcacattggaacgtcacggcaacaaaatcaatttatcgagcggagaagtggctatctcacttgacttagtcactggagagtcttctggcaaagatactttagcttttgaccatagtcaaatcattttgaaagcattcaaccgtgtagtcaataaaatggaacacgaaccgcaagttttgcaagttttaggtaaagatttcacgattacagaagctcgaaaagtatttgcaaagttcttaggaatcgattataaaacgatcgatcattccaattttaagaaagctatgctccaatatttcgacgagattggcgaacgtcctgtaggaatcggtcgcccttcaaaaatctatcagctcaagccggggcatcatgagtaaggattgtgaagaaagggctccgttctgaacactcaagaaaaatggaaagccgctctttgtgttttgcgttttttgctctatactttggcgtgtcagtaaaattcttcgaataaaaaaataacaatagcagaaaaaattcgtacgagttttttctgctattgttttattggtttgtcataattagtgagcttttcttcaaaagaaaattcctagaaacaaaagtcaatcagactttttattaacaaggcgaaccctaacgctcctgtcagtttcattcattttttattccttgatgaccgaatgcctacctagttgttctaacacttggctctttcttacagaattgctttcttctgctccgtcggtattgatcaaaagaaattttttattataccattgggacttataacgcaattttgttattaatttatgccagtcatgaatagaaaaatcagcatgtgcctcttcttttggaaaagattctacaaataagtagtcatattgtttgaccaatttcccagataattgttcaagataatcttctcgctggttcttttgtttcagataaagatccattacttttctcttttgtttctgataattgcttgccttatctaacctggtctttctatggtgagcggagcggacttttacgcttaatttccgctgtgcatgctgaagtttttcttctgtctggtcaaattttggcaaagttacttctatgggctgcgatgtttcgatcaatgtttttggatgataggcaatcccaatccatttagctgaagattctttttttattgatgaaacatcacaaagtagtgcgacatagaactcttcattatatcgagcagaaatcgtagcggaacgaatcgtgccttcgactggacggtgctggtttatcttgatcagttctttttgttttggtaattttaagtgaccgtttttcagatagaccgtatgggtttgattattcgtcgtataagattgccacatactttttttcgttttaagctttggaaagctggcacgtcccttgaaataattgcgaaaagctcggtccaaattaagctgtgcatttgctaaagcaagactgtctacctcttttaagaatgggtattctttttttaacgtagcaggcgtgagcgaaaaatcggccactcctgtttgttgccaacttttctgccgttctttcagcaaatggttataggtaaatcgaacacagccaaaagtacgaatcaattgctgtttttgttcttctgtcggatacatacggaatttaaaagcttttagcatctatgtccctcctagttagcaaccagaagagattccttttgtcgttttaatttttttgcataatatgagacttcctgctcagttgcataaacaaaatgttctggtgcgatttcacgaagctgacgtacttgtccgtcatctggttcgggttgatatttgattcttctgcgctttctctcatgatctggatctggcaaaggaatagcagataacaaactttctgtataaggatggacaccatgattatagatttcatcacttttacccatttctaataacaaaccgttatgcattacaccgattcggtcgctgatatgtttaaccattgataaatcatgcgcaataaatagataggtcaattgatgttctcgttggagatcttgcaataaattgacaacttgggcttgaatggaaacatctaatgcagaaatcggttcatcgcaaatgataaatcgcggttttactgctaatgctcgtgcaataccaatacgctggcgttgtcctcctgaaaattcatggggataacgagtgccatggctcggattcaatccaacggttcttaatagatcatcgacttttttggcacgttcctctggtgacttagctaacccattgacatcaattccttccgcaatgatatctctgactttcatccgaggattcagcgaagcgtatggatcttgaaagatcatctgaacatcatgtcggaatttcgtcaatccttttttgtctttgatcttcgttacatcttgaccgtcgaataatatctcaccgtcagtaggttcattcaaacgaatgatcgtacggccagtagtggattttccgcttccagattctcctactaaaccaaatgtttctccttcatagatgtgaaagctgatgtcatttacagcatgtacttcattcttttttcctacattgaaatactgtttcagtcctttaacttcaagtagtttatttggcatcagcaattcctccttgaccataagtatgtttttgtttctctttaaaaatagcccagcgacgttggacttcttctggcggtgtcactttaggcgcttgtggagcaagtagccaagttgctgccttgtgcgtttttgatagttcaaaaaatggcggttcttgttctgcatcgattttcatcgcgaattcatttcttgggtagaatgcgtctccttttggtggattcagtaaatccggtggagaaccaggaatggcatacaatcggtcgttcgcactgtctaatgtcggcattgagccaagcagtccccaagtatagggatgttgcgggttgtagaaaatctcttcggatgttccaacttcaacgattcttcccccatacataacagctacacggtcagcaacgtttgctactacaccaaggtcatgagtgataaaaatgattgatgtatcgatttttgtctgaatttctttcagcagttccaaaatttgtgcttggatagtcacatcaagtgctgttgtgggttcatcagcaatcaggatttccggataacataccagtgcgatcgcaatcacgatccgttggcgttgacctcctgaaaactgatggggataactattgatacgtttctcagcttcaggtataccaactaatttaagcagttctaatgcagctttttgtccctcttttttcgaaactttattatgctttctaagagactcagcaacttgtttcccaataggcatcgtcggatctaaagaggtcattggatcttggaaaatcattgctatttcttttccgcggattttttgcatctctctttctgtcttttcaacgatgtctttacctttaaagaggatttgcccagcatctatattggcattgcttgacagcaagcgcatgatgcttctggtcgtcactgattttccgcttccagattccccaacgatcgccaatgtttctcctttattcaaataaaaattgacaccgcgaatcgctcgtacctttccagcatacgtatcaaaagagatttctaagtctttcacttctaaaattttcgtcatcgtcctcactctttcattttaggatcaaaggcatcacgcaatccatcagcaagtaagttaaagccaatcatgataaccgataaagttactgccggaatccataacagataaggcagatacaggaatgtcttgtacccttcgctcaacatcgttcctaatgaagctgacggaggcgtaagacctaaaccgataaaacttaaaaaggcttcgaagaaaatagcagatgggatgctaaacatcatttgaataataatgacactggagatattcggcaaaatatgtttgaatgcaattttcattcttgattcacctaatgtcaatccagctagaacatattcttgatcttttaatttcattgtttgtgcacgaacgatacgtgccattggtatccagtttgtgatggccatagcagccacgatggaaaaaattcctggttcaaaaacgaccaacatcaagatcatgacaacgaggtttggaattcctgacaagatttccaaaaaacgttgcatcgcattatcgacacgtccgcctaacaaaccagatattaacccgtaagctacaccaatcgttacatctagtaatgcagcaataaatgcgatcaacaacgagattctcgttcccataaataaacggcttaatacatcacggcccaaaccgtctgttcctaaaaagaaacttacatttgaaggaacgtttgcttgagcatatttatccaccagttcaccgccgaccattgcttttccattcaatccatcgatattgattcccggaatacgaggaggcaaattgatataagccacattttgggcagttggatcatgtggagaaacaaagatcgtgaccacagagatcaaaatgatgaccaacagtaaaaacattgaaataacggcagctttgtttttctttaaacggcgccatgaatcttggataaaattcaaagaaggcgcagtaatctgctcacgttcttcttcggtatttttttgtaatggaagaaactcatccgcaggaatatctgcgactgtttcataacgctttggtgtcatttccatttatcctcggctcccttctgaaacacgaattcttggatcaactagaccgtacaacaaatcaacgatcaaaataacaaaaatcaacataaatgagtaaaggatcgttacagccatgatcgtaggataatcatttgttgtgatcgacttaacgaattgttccccgataccaggaatagcaaagatattttctaccaccagtgatccggtcatcaatgcgacagccaagggtcctaataaagtcatcaatgggatcaaactatttcgaagaccatgtttaaaggcgatttcccaacggctcaacccttttgcttttgctaattccacgtaatcactatgcagtacttccaccatttccgtccggataaatcgagcagaatcagcaagcggcgacatggccaatgcaattgtcggcaagatcgtgtacacaaagccatcccattttgcgattggtaaaacttgtaatttgattgcaaagatatattgtagtaaaacagcaaatacaaagtttggaatggaacgacctaatatcgctacaagtgtagaagatgtatctgcccatgtattttgcttcatggcagaaatcgttcctaaaatcgttcctaggactgttccaaagataattgcctgtaaccctaattgcaaagatggtccgattcttccagctaacaaatgtgcgactggctggtttttaaattggaaggaaattccaaaatcgccttgaagcaaattagaaagataaatcccatattgtacgataactggtttatccaaaccgacttgtttatttagcatctcgattgtttcaggactcaaacgttcctgattcgtatatggcgtgcccggcagcaattgcatcaagaaaaaggtgattgttgcaattaaccaaagcgtgatgatcatgaaaaagacacgttttaatacatatttgatataactattcactaatgtttccccctagcttttgacttctgacagatgtttcgctacattattagataatgaaccaaaaataaaggagcaatcaaatgaaaaaaaaatctatcccttacgcagtagcttttctactgattctggttattttaataaaaaacgtcatcaaccattcctttacactcattcaattatctaatgatctattcttatggtcattgccgtttctgattatcggcggttttttatgggtcttttcttcgggtttcttcgatcattttcagcgatcagtccatcttgcacgaacaaggaaccgaaagaaaaaaccagaattttcctcgctctcgtctgccagctacggtatgtacagcttttggctgatcattgccggaatactaattgctctttctgctattttcatgcttttttctttgttaggataagtaaatatgagaacgaggttgcgacatttgccgcagcctcgttttttctcatgctcacggtattaacgattattcttcaacgtatgtccatttgtaatcccatgaagcgcctgcagcatggtgaacgatacctttgattttttcattcactaggtgaccttctgctttttggtacaccggaacgacacccatatcatcagagatgatcttgattgctttttggaaatcatcccaacgtgcttgttcatcgccagcatctgttgatgaagctgctttaactgcttcgtcatattctgcattgctccagcgaccacggttgtatgaattacctgtgacaaacaaatcagtaaagctgcttgggtctgcatagtcagcagcccatccgcctagtactgcgtcaaaatcacccgaagttgagcggtcaagacgtacagagaatggaacaggtgttggtttgactgttacgccatccaagttttcttggattgagttttgaacatattcgattacttttttcgatgaatcatcatcagaagccatcaaatcaaattctaaagaatcaacgcccaattcttttttcgctttttcccaatattcttttgctttgtctttgtcataagaaactaattttccagcttcttttgcaaagtcttcgttcgttgttggactttttaccatatctgatgggatcaatcctgtagagacaactgatccgtcacctagtacttgttttactaaagcttcacgatcgatagaataagaaatagcttttcttaggttcacattgttgaatggtgaattcttttcgcgttggttgaattcgatatagcttgttcgtgcttctttaacagaagtataagctggatcgtttgcgttttgctgtgctaattcaccagacaagatcacatcatctgcttggccatctttgaataagttcaaagcagtagaagattcttttactacactgactttgatttcagaaagttttactgtgtctttgtcccagtaatggtcatttttcttataagtccattctgtatctgttcctggtccatcgaaatcttctaatgtgaatggtccattataaacagctttatcacttgcagatgcataggcatccccattttcttccactacggattgtttttgtgggaaaaatgatgggaaagcaagcaggtattggaaatatggtgtttgtttcgtcaatttgatttctaattcatagtcgccaactgctttgatccctagttctgatttatctttctttccagctgtgatgtcttctgcattttcaactggcgcatacaggtaagcatattcagaagctgtagctgggtctactgttcgttgccagccataaacgtaatccgctgctgtaacaggatcaccatttgaccattttgcgtcttctcgtaatttgattttgtaagttaatccgtcttcactgacttctgccaactcgctagctcctgccggctgtggtttgctatcttcatcaagacggtaaataccttcataaacgttattcaatgctgtaaaactgattgtatctgttgcaactgataagtcagctgtaggcatttcttgaggcacgactaagttaaatacgcctcctccatctgctgaaccgctttttgctgaactactgcttgtggctgaactgccgccataacatccagcaagtacaaggccgcataccgcaaccaacccaaatgtaaatttctttttcattttacgtacccctttattggaattttcagaataattaatattttctgaagttgtttaagagtttaatgaataattattaaaaaatcaacacttttttttgtctttttcataaaataatgattttttcgtgaggtttcaaggaatttttcagaaaaaatagctttgtacaaggttttctattgtctttcagtagccattaaataatttttgttatattgtctattattgccatacaaagataaaaaagaataaacaaaaaggaactctgacaaaagtcttgtcacagttccttatccgaataaacggtgttcaatcagctgaccctcgatattagctcaacaaacggcaaaatatgaagaactatttttccgtttgtttctctaatactcaggtcaggacgctgatttcaccacctctttttattattgagaatctggtcgaggaataatcgtttttgccatccaaatatccggtttgtcccaaccacttgcatttggtaagacacctacgattttataacctaatttttcatagaactcatagggatgttcacgaaggttctggatggatgccactttatcaaacgtatgctcatacaggtccgtttgacttaacgttgttccatggtctaaatcatccgtacctaaataaatcgtgattcctcctctggaagctacttctttttctaagtaattgactaatcgagtacctatttggttctttcgtcgggagctttctacaactaatggatgcaattcccaacctgtgataccgtattgagggattgcaccaataaatcctactaactcatcttggtcaaccgctgctaccgcgatccgttctggattcatcatttcttctacttcttctgccgagctgtctccatattcttccggccaagtcagtctcagtaaatcagaaagctgatctttcaatactggattattacggtcaaattcactgattatcatacgtcttcccccttgttcttgcttattctaacagtccttttgaaaaaacgaaatgttctcgctcaaaaatctttagctaccaatcagtatctctattctttcattatttaccttacttataaaataaaaaaattatacagaaacactttattcaaaataggaaagatcaggaaagccatcaattggaggaaaaaactctgtttgttcatcatgatatagattatcttttgctttaaaaaaaccaattatgaattgacaaatgaaacacatttttataaaataatctaaatgttcagaatttttagattatttaaataagcaagaggaatcgtagaaatactaggaggaacaaaaattcattattgtcgttttcaatgtttatgtacttattttatttttaggatacttattgatgatttcaaggtgttcatgccaccttattcattacttatcctgtcttagattcgcctctactccatctacagccgcggtcagaaagatcactctttaaaattttaacccgtttcaacgaagaaagaaggaaaagaatatgagtcaaagtgttttcttaccaaattataccattggaacagatgcgtatgaaaaagcaaatggaatcgtcaaagaatatgggaaaaaagtagtgctgattggagggaagactgcactttcaaaggcagaaaacaaaataaaagcagctttgactcaggaaatagaagttatcgccagtctctggtacgggggtaattcaacttatgaaaatattgaacagttgatccaacatgaaagtgtccaaaaagcagacgtcttgtttgcagtcggcggtggccgtgcttgcgatactgtaaaagtcattggtgaaaaactagctaaaccagtcttcaccttccccactattggttcgaactgttcgcccgtcacggcggtatgtgtcatctataacgaagaaggcgtaatggacggactcttctttccttcaaaaccacctgtacacaccttcattgatacagcaattattgccgaagcacctgataaatacttatgggcaggtattggcgatgctttatccaaagaagtcgaatctactttttctgctcgtggcgatgatctaggctacacggatagattaggaatccaaattggaaaaatgtgcattgatcgcctcttgacttatggtacgcaagcattgaaagatagtgccgacgatcgtccctcatatgcaattgaacaagtcgtttcggatatcattgttactaccggattggtttctgttttagttaacaataactataattctgctatggcacactcattctattacggtacgactgttctagaaaaaatggagggataccttcacggagcatctgtcagttatggtgtactgaccttattgatgatggatcagcagttcgatttgtttgataaaatctatgtgtttatgaaaaagaaccaacttccagtatcgttagccgacatgaatctcaatgtcacgaccgatttagaagcaatcttagataaagccatgaccacaaatgatatcaaacatgtgccttatgaaatcacccgagaaaaatttaaacaggccattcttgacgtagaaacttatcatgctacacaagaaagccagcaaggatataagaaaatcagttaaataattgctaaaacccccatcaagcaggctgtcatcaaattgacgacatttctttgcttaatgagggcttttcttgtcaaaaaacgctttataactttcgctatagaatcttttcacttatttaagttgaacagttccttaattaagaaaactgctccttttatggtaattgaaaaaacgaagtaggctacgattatttggcagctgtttttttcatttgcttgcttcgcaattgtccgcaagctgcattaatatctgtaccatgttctttacgtatcacacagtttacgccgtttttcttcaatacatcataaaatctcaatacatcagcttttggactgcgagaatattgatcatgttcactgactggattatatggaatcaagttgacatatgctaattttttcttatcttttaatagatctgctaattgttgcgcatgctctggtctatcatttacttgattcaacatgatatattcaaacgtgattcgacggtttgttttctctaaatactcatccacagcttccatcaatttctcaattgggaaacttcggttgatccgcatgatcgatgttcgcacctcattattcggcgcgtgcaaggaaatagccagattgacttgtaagccgttattagcgaattccttgattttgtgtgctaagccactagtagaaactgtaatatgtcgcgcaccaatcgccaatcctttggcatcattaataatatgcaaaaagtccattacattgtcgtaattatcaaatggctcaccgattcccattacgacgacatgggaaacacgttcgccaagattgcgctcatcaaaataatgttgaaccatcatgatctgcgcaacaatttctccagcggtcaaatcacggttctttttaagcaacccgcttgcacaaaatgtacagccgatattacatcctacttgtgtcgtcacgcaaacggacaagccgtattcttgtctcattagtacggtctcgatcatatttttatcaggaagttcaaacaaatatttaactgtaccgtccgaagcttcttggacgaccatttgtttcagaggattgatgataaaatgcgccgataatttttctatcaattgttttgacagattcgtcatttctgtgaagttacttacacgtttttgatacaaccattcccaaacttgggcagctcggaattttttctcaccgttttctataaaccaattgattaattcttcattcgtcaagccatagatggattgtttttccaaagtattttccctctttttctcaaagtttcgctacatactatacatgattcgtttagttaatgcaatacttcacaaataaatcgaatagaactttcatctcataaaaagcaaaaaagacaagacatcctaccgtattagaaaagatgggaaaaaagccattttttctcttggtatcatcatgtcttgtcttttttatatagttattcgtttttcaaccgttcatcgaacaagttttacatttcattatcttccggcagtggttctgatgtttcctcttgctcaatgaatactttacgaggcttacttccttctgatgggccaacaactccatgagcttccagttcatctacgagtcgagcggctcggttgtaaccgattcgaaaccttctttggagaagggagatacttgctgtttgcatttcaacaacaagtgcttttgcttcctcaaacagttcatcttgtggctgttctggggcacctgccgtttcaacttcatctgtcggcatcattttctcttcatagtgagcttcttgctgatctgtaacaaattgaacgacccgctccacttcatggtcagagatgaatgctccttgcacacggataggtttattctcacccattggcaagaacagcatatctcctcgccctaagagcttttctgctccattagagtcgatgatcgtccgagaatctgtaccgcttgatacagcaaatgccattctggaaggtacatttgctttgatgatccctgtgataacatccacacttggacgttgagtagctaggatcatgtggatgcccgctgcccgagccatttgcgctaaacgaataatcgcatcttcgacttcgttgctagctaccatcatcaagtcagctaattcatctacgattactacgatgaatggtaaggttggatgtttcgttccgttttctaagtttttctgctgaacaaattcattgtaaccagaaatatttcttacaccagttgccgcaaatttttcatatcgttcttccatttcttgtactactttttgtaaggcttgtgccgcttttctagggttcgtcacgaccggcgtcaacagatgaggtatcccgttgtacatatttaattcaaccattttcggatcgatcatcatcagttttacttcatggggcttagcacgcatcaatatacttgtaatgattccattgattgctactgacttcccactaccagtcgaaccagctacaagtaagtgaggcattttcgaaaggtcagccgtttgtactcgtccagaaacatcacgtcctaaaggtacttccagtaatttatctggatggtttggctgagcttcgatgatttctctaaaggaaaccatactgatctttccatttggtacttcaataccaatcagtgatttacctgggatcggcgcttccatccgaacatctttcgccgctaaagcaagtgcgatatcatctgttaagttcacgattttacttacttttacccctacagctggttggacttcgaattttgtgacggatgggcctaaactagctttgacgaccttagcatccacaccgaaactttggaaagtttgttccaatacaccgatatttttttcaatttttttatactcatcactttgatccacagttggtatagaatcaagtaagtcaactgtcggcaattcataatcttgattttcctgttctgcttcgatctcaaattctaatgaagtaccgtcatcctctggcaactcatcagctaaaccttccgctgtattggtctgttttggtgtatctggtactggtttctctagattcgcaggatggatattttcttgaaaactgtcaattggaacaaaacttaactgctcaggttcggcattttctggttcctgccattcatcaggagtatttttcctttgctggttcacagcttttttcttctcatattctgcagcttctttttctgctgcttcttgtgccgctaagcgtcttgcttctttcgcttctgcacgctgtttcattctttcttcctttgccgcttgcttttgagcttgcttggcaggatcaccttctaataattcctgtacccgttctccaattgattggataccattcagcagctgatagccttccaaattactgaacaagaatgctccacccgccagtaataaaacagctgctaaataacttccaggctgtgcaatcaagaaataagtgaaatgataaagaattgctccgatcattcctccgccaacgttattatctacttgactttgttttatatcgctagctaataagtcccatgtcgttcccatgatatttggttccccagtatggagtttgccgaataaatgggcatgtagcaataataagataccgaaataaaagagtataccgccaaaccagcgtcggtttttgccaattgaaaactctgtattcttaatgacaatccaaaatcctaatacggctaataaaagacagaggatttggtaagtatttcctgcaatgatccgaaagccgtttgcaatcaatattcctaaaaaacctaattttaaaaagccgaatacagcaaatagaatcaaggcaaatccaacaccaatcgtcagcatttgttcttgctgctgtttttgctttttcgtttttttcgtctttttccttttcttagtaggccgtttcttttgtgccatttattatccctcatttcatcaagtttcattatacaaaaaaaagcaagggaactaaagttttgtttgaaagaactgacgctttcttttacttttcagcttattttacagtttttcttaatttataaatgattttatcaaaaaaaggcacggccatatccagccgtaccttcttgttttaagcatgagaactaaaggttctctccattttcttcgatcagtttttggtaccagtaataactgtctttcttatatcgttccaaagatccttcttgtgtttcatcttgatcgacatatacaaatccatatcgtttttgataaccgttcaaccagctaagcaaatctgtataagaccatgtacaatagcctaatacttctgctccatctgaaattgcttctttgattgctttgacatggctttgtaaataatggattcgatagtcgtcatggatttgtttgtcttctgtcaacttgtcatactctcctaagccattttccgtgatcagcaccggcatgcggtaacggctcgtgatacgacgcaatccgatccttaagccttctgggtcgatttcccagtcccaatttgttcgttcgacaaatggattctcaacttttttatacattccaggaacccctgtttcttctgatgaaccttttttcccggtcgtattcatttttcctgctccaaccccatctaatggattgaatgcattcgtcgctgtttgatagtaattgatcccaaggaaatctggtttggctgattctagcaattctgcatcgcccgcttcaatcgttggcgcccatcctttttcttctaagaatctcatagcagcaataggatatttcccccacatatagacatccatccagtaattggccattagatcttctgcattttcggctgccagaacattttcaggattactgtcgattggataatttggcgtatacgcaaagcttggtccgattttcccaggcatttctaactcatggtatttgttgatgacagatgcatttgctagatttgcgatatggttgacttcatacattcgttttggatccgtcacgcctggcggatgtgctgctaataaatagcctaatgaagtgaagatattttgttcattcaaactaatccagtaatggactttcccgcggaatgcctcaaataatgtttctgcataatgagtgaaatcttcaataatctgacgtgactcccaaccattatattcatcttgcaacgcttgtggaagatcccaatgatacaaagtcaacataggttcgataccgttttcaatcaatttgtcgatcaatctctcataaaaagcgagcccagcttgattgacttctccgcgcccattaggaaaaatccgtgtccaagctacagagaagcggtaagctttcagaccttgttctttcattaaagcaatatcttctttataacgatgatagtggtctactgccagatcaccgtttgttcctttaaatgtctttcctggaattcgaacaaatcgatcccagactgattcgcctttcccatcttcttgccaagctccttctacttgatacgctgcagaagcagagccccacagaaaatcttttggaaatgaggtaagttctttgtgttccattcatctcttcctttcctataaccttcaatcgttcctctttttagaataacacgaaaccccttccataacaaaataaaattatgtaaaacatactaagattagaggggaacatcattcgtcaatgatgttcccctctaatcttagtatgtttttgttaatttctcggcgtgacatcttcaccaaaccatttattggagattttttggaattcccctgttttttctaatcgatcaaatgcttcatttatcttcttcactaacgtatcatctgacttacgcacgccaaccgcaaaatcctcactttcgtaagaaccttttgtcatgttgaagtcttctagctcgtttctttgtttcaaataatagtccgcatatactttatccatcagcaaaccatcgatccgtccgcttttcagatcaatcagtgcttcattaaaactatcgtacaaaacagcatcttggtttttgactatctcttttaacacttctggttgttttgtaaatacatcataaccagatgacccattttgcgcacctaatctcttatttttcatttgctcaaagcttgtgattcctgattctttaggtgtgatcagtacttgatcattttccatataaggttttgtaaactgcactttcttttctcttgccggtgtcttggaatagccattccagatcaagtcgatcgttccattgttcaattcaaattccttcattgaccagtcaataggctgaaagtctaccgtaatcccatattgttcaaagactgctttggctaaatcaatatcgaatcctgtaagcttcccgtctttatctctaaatcccataggaacaaatgtatcgtccaaacctataacgatttttttctcttcgttgatagccgcccaattatctgctgaagcctttttattcgaacagcctgcaaaaagaagaagacctacgagcaaagcgaatagaaaactgatttttttcatctctatcttctcctttcttaacgaattggggaaacttttaatagttgatcaccgacattttctgcaaatacgagatcatgtgtgacaatgatttgggttaccccgtcttctttcaatgataggatcaaacgctcgacttgctgacgcaactcaggatctaaagcactcgttggttcatcataagccaataccctcggattcatggccaatgctctggcaatcgctacccgttgtttttgtccgccagaaagctgataaggatagttattcaataaatcgctaatccctaatgaagccgctaattcttctgcttttttggtgtattcttcttttgtctgtttcaataccattttcggtgctaaggtaatgttttcaaaaatattcagatgtggaaatagctggaagtcttggaatacgactcctacaacttgttctttcattttaagttcgaatggattgaacggtacaccgtctaaataaaattctccgctgtcagagctttctaagccagccaagatacgtaaaagtgtggttttaccgccaccggaaggacctacgatagctaatgttttcccatctggaatgattagatccaaatctttgattatttctttttcaccaaatgctttgttcactttcttcaattcaatcatatttcttcctcctatcagttagcggtaataatttaattttccttcaacttgtttcattacgattgttagaataccagtcaatgtaagatagatgattgccacgcctagcaaaggcagtaaagtcgcgtcgcgttccatcgcgattttcccggcacgcattacgtcacctaaacctaatatatagatcaaggaagaatctttgaccaagttgataacttcattacctacagaaggtaaaacaatctttgttacttgcgggatgacgattttcgtcaccgtttgaaagggacttaattgcaaaacttgcgctgcttcatattgaccttgaggaatcgattgtatccctccacggaagatctctgcaaaataagcggcatagttcaagataaaagcaatgagcgctgcttcgaatcgatcaaaaacgatcccaatcgtcggcaaaccataaaaaacaaaaatcagctgtaacaatagcggcgttccccgcatgatccatacatatgtttgaagaaagtagcgtagtggcttaaaatgcaaggacaatcctagtgctaaaataatccctaatggcagcgagccaatcaaggtaaataaaaataatttcaatgttgtgagtgctcctactaataattgcggcataacttcaattaaatactccatcttcttttcctcctttaaaataaaaaaatcctcttggcaaatgccaagaggacgtattatacgtggttccacctctgtttattttttccttgcagaaaaaacctcacacagtcgttgcaaatcagatgaaaacaaaaagtcctttgatccgaagatcaaaggacgttaatcacgtggttccacctttttttaccggctcctcacggaaaagccagccttatctggtcatctagcaacgaccgcagctgtaacgggctccccggattttcctactatacgcttcagaaaatcgactccaagatgtgtttcacggttaactgctgcctctttccaccaaccagagactctctaaaaacacctaactgctactcttcttttcgatgtcatttattttaactttacgtgtaatttacatgattatttttcatttgtcaactcttttttatgatacactaataaaaaaggaggatgatgcgcaatgagtcgtgcaaccgaacaagaagcttatgaactactaaaaaaactggatatctcttttcaaaaagtcgatcatcctgcgattacgtcagtcaaaaatgtccctttttccctacctggtccgcaagtaaaaaatctattattgaaatcaagaaaagaaaaaaaaatctatcttgtcatcttgcctgatgaaaagcatgccgatttaaaacaactagctgaacaattaaaagaaaagcgcttatcttttgtttctgaagaacagcttcctgaccttctaggtgttccagcaggtacagtgactccattagcattgatgcacgacaaagagaaaaaaatccaagtcgtgatcgatgctgctattgatcgtcaagataccgtaggctttcatccaaatatcaataccactacgttgatcatggatttttccgactttgaaaagatacttgtttacttagaacatctgccagtttatgaaaatttgtaatgatagagtagttttcttatttcccaatccaagcgtctttttctttatttagtacaaaatatatcagaaattcttttagccaatcaaacaatgtaacaactagtatggacactgaaaactagagtattcttccatagttagccaaatccatatttattgattctacgaaaagaggctgggacagaagcgtttaactccaagaaataagaagaaattcacgaaaattgcttttcaaatttttgtgaatttcagcttatttccgaaggagttgcttctgcttccgccgtttatacgtgtttagagcgtgagacaaaagtgttctttgcttttgtcccacgctcttttcaattataaagcggaattttattcttttgctttcagtcatatttaacaaaaaatattatattctgaataacaaaaattattctatctacccgtggtgctagttaattttaatattctaaagaatatctcaaagttccttcaaaacgtcgttgtactcgacttaatagaacactgtaagccagtaatatgctttcaaatctactctctagatttttgagctatgtacaagaagcattttattctagcttaatttgacaaatcatattatttatttgttaaataaataggaacaaaaaaattaaattacttaatacacacattagggatcattcattgaaggatcagaagacaacgaggatggcgaaaaatatgattacaatagaaaagtcgttctaaacaaatcagttcctagtatcacacaacgcaagccagtcgatttggtgagattagaggagtgaaagcaaactttattatataagaaaaaatattcgaaagggatgctagtttaggtactagtgctgatgaattaatatgatgcctcgtaatattaggcgtagttactctagagacatcactatggactatgatttgtctcagagtcacaacatgtttttttatgaaaagaaacagctaaaataattaaattgcgcaatgtttaaactttcttaaactataacctaataaatgtgaagaaataatgcacaatttcttcacatttatcttctattctatgtacataccaaccaacaaccctatatactttttcatttttactcctcaagtaaaaataactcctagaccgcggatacccaccgcggtcgtttttttattcttcaatcaaaatcgctttgatacccaaacctgccaagattcgggcagaagtataagtattcaatcctcttctgaaagtaatgtaaacttttttatcttttgggatttcattgattcgatctcgtaactcattcattggaatattttttgttgccgagatactgccagaaggtgctttattaggttcacgtatatctaaaaagaacgcttctttcaaatcgttttcgggtatatcacttgctttgatcgtttctacgatattcgtcatttgattgattgcgacataaccagctatattcaacgggtcacgggtagtagaatacggtggagagtaaggcaactccaaatcaggcaaatcaaagactgtcaagtttccggtgatcgctatagaaagttctcccatccgtttatcgacacctttttctccaaatgcttgtccacctaaaatacgaccgctatctgcatcaaaaatcagctttagatttaatcttgtagcttctggatagaaataggcatggtcaaaaggagtgataaaaacagttttataatttgttatgcctgatgcttttaatgcatgttctgtcattcccgtataacttgctgtatgatcaaagatttttgcgacacctgcaccaatatatccgcgatagcgcataggcgtaccatttaaaatatctgccaacatatgtccttgacgattggccgcactggaaagcatactttggatcggctgaccagtcactacactagtcgtttcgataatatcgccaatcgcatagatgtccggcagattagtttgtaactggtcatcaacaatgatctggcctgtatctgataattgtatgccggctgctttcaccacttcattattcggagaaacaccaacagcaaagattagcatatcagcagaaaggacggagccatctgataatactatttctcgacctttatcacggatctcagtaactcttgtttctaaatgaacggctaatccttctttcagcaatttgtcataaactaaatcagcaatttctggatcataagggaaagcgacttgtggcaattgatcgattaaagtcacgtctaagccgcgatgcttgaaattctcagctaattccagacccataacacctgcaccaagaatgacgacatgttgtggatttttttcttcaaggaacgatttgattcgatccgcatccgtcacactacggaggacaaagccgttttctgcttcaaaaactccgggaatatccggataatctggtctagcaccagaagagatgatcaacttatcgtaatctgtttttgtttcttcatttgtggataggtctttaactgttaattgcttagtagaaggatcgattgctgttacttcgtgtttagtaaagacatcgatgttgttttttgttttcaatatttctggtgtacgttcgatcagcgagtcacggtccgtgattacaccacctaaataataaggcaaagcacaacttgcgtaagaaatattctctccgcgttcatagataatgatttcatgtgcttcattcaatcgacggaaacgagtggcaaatgaaggaccgccagctacaccgccaatgacaacaactttcataaaaacatctccttttctatgttgatcgtactatgttatggcaaaaaacagcaaataattgtgccggaaaattattgtttattttgtcagtagagaaaaatagtaagaaaaaagagaacggtttcgctatgtttctgcataaaaaagaaagaggctatgacaacagggctgtcacaacctctttccattggcttttaattctcgtattcttctaattccaagcttagttcttcccattccgacaattttgtttcttgatcttgtctagctgattctaaagcttggttcagctcattgagttttacgtgatcttccagattttctggtgcgaccatttcttgttccaaccgatcgatccattcatcgatccgcgtcatttcttcttcaacctgagtgatttttcgttgaaggctacggataagcttttgctgttctttgctctggtaataatcggatttattcgtaggagcaggagcggattctggctcatcttgtgccaataattcggcgatttcttcttcttcttgttttttctctaaataataatcatagtctccaagatagactttactgccattttcagagagttcgacgacttttgtcgcgatccgattgatgaaatatcggtcatgggaaacaaaaagcagtgtgccatcgtaatcgatcaatgcattttctaatacttctttgttgtcaatatctaaatggtttgttggttcgtccaagatcaaaaaattttctttgttcatcgctagcttggctaaagcaacccgtgctttttcaccgccgcttaacagagggattggtttttctacatcttcgccagaaaataagaaagcacctaaagcacttcgaatgtctttttcaggagtggtaggatgctcatcccacaattctgctagaatcgtcttgtttgtatgcagatcagcttgcccttgatcataatagccgatggtgacatttgtccctagcgtttctttgccacggataaaagggatctggtggatgatcgatttcagcaacgtcgattttccgataccattcggacctactagagcaatcgcttcttgtcggcggatatccaaattgattggttcagataaggtgacatcatcatatccgatagcggcatcttcgatttgcaagacaacatttccagaaggtttttctatactgaaaagaaagtttgcttgtttctcatccccttgaggacgatccagacgttccattttttctaatgtctttctgcgactttgcgcccgtttagtggtagaggcacgaacaagattccgagcaacgaagtcttctaatttgtggatctctgtctgctgcttttcataagccttccattcacttgtcagctgttctgctttcaagtctagatacttcgagtagttgcctttgtaatggcgcatttttcttctgcttagttcataaacttcattgactactttgtctaagaaataacggtcatgtgaaacaatcagtaatgcaccggtatagctttgcagataattttcaagccaggaaagcgtctcgatatctaaatggttcgtgggttcgtctagaatcaaaatgtcagggtgttgcaaaagcatgcgagctaaagctaaacgtgtacgctgtccacctgataaagtatcgattttctggtcataaaaggaagaatcgaatttaaaaccatgcaatacggaacgaatttcattttcataaccatagccgtttcgatccgaaaaatcgtgttgcagccgatcatattcttttaaataagaagtataagcgggtgtatctggcgtaccttcgctaatgaaaatctctagttcacgcatccgctgttccatttgtctaacttgttcaaaagctttcagcatctcgttccacactgtttcattggaatcaagtcctgtgtcctgagcgaggtatccgagagtcgctgttttatttttagcaatctttccatcatctggtgcttcaattccagcaatgatcttcaataaagtcgattttccagcgccatttctgccaactaaagcgacacgagcgcctgtactgatttctaaatgtatgttttcaaataagacttctgcaccaaaatggcgagcaatctgattggcttgtaataatatcatggaatcctcttttctactttgtgaattctcctcaaataaaaaactatttttcaattagtagtctaccataaattccatcatactgcgagatttgcagaaatgataaataaatgaataaagaataaaatttcacaatatctgagcaatggaattgattttttcctataaatactgctatgatggagaaatcaaagatgtaattagacaatacgtggaggtcatttcgtgaaagatcatattattccaaaggcgacagctaaaagactgcctttgtattatcgttatttaaggattttaaataatgctggaaagaaaaaagtgtcttcaactgaattaagtgaagccgttcaagtagatagtgcaacgatccgtcgagatttttcttattttggcgaattaggaaaacgtgggtatgggtatgatgtagaagatcttatgcacttttttgcgaagacattaaatgaagatcaattgacaaatgttgcgctgattggtgtagggaacttgggaagtgctttactaaaatataaattccatcaaagtaatagcatacgtatcagttgtgcttttgatgtgaatgaagaaatcgttggacgcatcgtagacggtatccccgtttatccaatggaagatatgtcggaacaaatcaagatccagcaaatcgaagtagcgattttaacgattcccgctgaaagagcacaagaagtagtcaatcagttaacggaagcaggaatcaaaggaatcttgaactttaccgctgctcgattgaatgctccgtcagatgtattgatccaaaatgttgatttgacgaatgaattgcaaaccttgatctatttcttgcattctgacgcaaatgcgcattccgaaaatacagcagaataaaaataaaaagcgattgaacaaatgaaggcaaaactttcacttgttcaatcgcttttttctgtttggataatgtttattctgttcgaaagagttcttcataagaaagagaatcatcttctgctgtcagttcatctagtaaatgccggatttttttaaagtcgatgaaccgcgcttgccgagagatctcttttccatgatgaaaaaccagaacaactggcgcagtcaatacttcaaatctgctagctacttctggcgtttcgaatgcatccaaatgaagtgccggaatatcataatgggtgagcagctcctccaatcgtggacgaacagcgtgacaaacactgcaattaggcatcgaaagataaacgatggcaacggatgattgttgcagtatgtcttgaacttcagacaaattagtggtttgtttcattttcattctcccttttgtgatagaagtgatatgtacgagaccttaatttaatgggaataatagaaaaagtcaattgaagtgcttcgataaaaaataagagttgtgtaaaaattgacagagcaacttgtttttttttgaataaaagcgtatatttgcaaagcgaatgaactagaaatgaaaaggaggaaactcatgttttcttttattcccaattcggttttgcagatgagtacgattttcttatcgatcgttatcgaagcattgccctttgtactattaggttgtcttatctcaggcgccttacaagtatttttgaccccagaacgtgtgaagcgatggcttcctgaaaatcgtatattctctatttttactggttcgatcttaggatttttctttccttcatgtgaatgcggcatcgtacctatcgttcatcagtttgtaaaaaaaggcgtgccggttcacacagcatttgcttttatgctgacagcgccaatcattaatcccatcgtgattttttccacgtttatcgcatttggcaattcttggcagatggcaagctggcgagtgataggcagcttttttgttgcacttgtgattggtgtctggcttgcctattttcaaaaagacgctgtattgaaagaaaaaatctcctctaaagtagccgaagatcaccatcatcatgcccatgaagaagaacacagtgataagaatgagccaaaaaatcggctgttccatcaaacggggcatgtgttgacacattcaatcgatgaattttttgatacaggtcgttatttgattattggtgggttaatcgcagctgcgatgcagacttatttaccaactagaatgatgctaacgctcggctcaacaaagattttagccatcattatcatgctgttattagcttttacgatgtctctttgttcagaagcagatgcgtttatcgggtcttcattgttaagtctgttcggcacagcacctgtagctgcctttttggtctttggtccaatggtcgatatcaaaaatctattgatgatgaaacgatattttacaggacgttttattctatcgctgatcggactgattgcccttagcgttgttggattcacattatttatttaggaggaaaaatatgctgcggtttttgattttatctggctatttcgaattgatgatgtatttgcaagtctctggcaaacttgatcaatatatcaatgtccactatcgttatttagctattctttcgatgattttatccgctcttttggctttagttcagctgtatttgtgggtcaaaaacggaaaagcagaggaagagacgcacgagcatgatcatgatcacgaccatgggttatcgaaaccttatcaacgtggaatcgcctatgtactgcttgctttgccagtgatcgttggtacgttgtttccaacagttagtctggacactacaatcgtagaagccaaaggatttaattttccggtaagcaaagaatcggtaggtgatccggaaatgcagacacaatacctaaagccagatacaagtatttatttcaacaagtcagactacttagaccaaatgagtgaactgaaagagaagtatggggataagcagactatcgagatcacagatgaaaattatttagaagtcatggagctgatctataattaccctagcgaattcattggcaaaaaaatcagctatgaaggatttgtttaccaaacaccgaacgatagcaatgcagatgtcttcttgttccgcttcggtattatccattgtgtggcagattcaggagtctttggcttgttaacacatatgcctgaaggagtaacggttaaaaatgatgagtggtataaaatagaaggaaccatccaatcggactattatcaaccattcaagcgtgaaattccatctgtagttgtgacaaacgcagagaaagtcgctgctccgaaaaatcagtatgtgtatcgttctttttaaaagaaaaaaataaatgaacatagctcagacagttgacgtgtaaggacgtcggttgtctggctttttttgtatgagatatttggctatttgatatgttttgtaaaatgatatttattttagaagttgcatgctgaatgtagttaatagcggtttcaaaggtgttggaaaagattgtgaagagaattacaatttattcctaacatgtatgttgaaaagttgtatgaaatgattttgatagtaaaatatcgagtggaggtactttgtatgataacacgtatatttattttggatgacagtttggtttttgaaaaaatgatagaagatattttggaagaatccagaaatttactgattccttggaatttcgagataatcaagggattgaacgtcatgcagtttgttgaatttgtcaaaaacaatgatattcgttcatcggatatttttttcttgatatcgatttgaacgcttattacagcgggattgaactaggagaaatgcttagagaaaagaacgcgaagtgtaaaattgtttatttgacctctcatccgaataaagcaatagctgttattaaccgaaatattacgcctagcgggtatttgataaaagaattcacttatgaaaaaaataaaaaaaacatccaaagttacttattgaaagaaaaagagaacgagcctgttcaacaagcgaacaaaaaaaagtggacgtctgttcgttatggcaatagcgatcattatatccattacgatgagattctttatctaatgagcatgccaggctataaaaataagataggtttggtattgaaagacgaagagacactcataaacggcacaataaaaaaatataaaaaaacactggaatatgagtatttatgtaaagatttaaaagtctacatcattaatactgaaaacattacatctattagccgagtaaatgaagtagtaacgtttacgaatggagaacaactagagatgggtaagagaagtattgataaactaaagaaatttattcaagaaaagataaggaatgaatcattttaaaaaattaaaaataaaggatcatatctcactttttagtaaacagacttaagttaatcatgcaagttccttcttccattttgtttctctaatactcggaccaagatgctgatctccccccttctactaaacagtgttccagaagtagtttcttcgaaaaataagataggattcacaaaaatttaagaaaccattttcgtgaatcctgtcttatttcgtgaagctaatcacttctgtcacaaccttttctttgttacacttcgtttatttaaaaagccgtttttttcgtttcaacatgatggcatcacgctttactttgaagttgcggatgttatggttaaagacttccgataatacgagacctaaagcaattgctccagctatcatgattgcttggaccgcatagtgagctgcttcttgataggattcagtaacgagattccgaaccgcttgataagccaaaccacccggaactaaaggaaccatcccaggaatattgaaaatcgttacaggcattctcaaacgcttagagaaaagatcactgatgaatgcgactcctaaagagccaagcaatgacccgaaagcagcagatccgcccatttgaacacagatccagtagatcatccagccgaaagcaccagaaagaccacaacaaatcaatgaacgcctagggacatttgtaacaatggcaaatgccgcagtcgctaaaaaactaaaagaaaattgaataaatatcgtgcccatactcgtgttcctttcttaataaaaaagctggaaaataaaagcaatcgcaaaaccaatcatcgtagcagtcatcatcgcttctgttccgcgagaaacccctgacacataatgaccagctagcaaatcacggatagcattcgtaatttgaaccccaggaaccaaaggcatcacacatccgataataattaaatcctgattgcttcctaagccaaaacgaacactgtagatagcagctatgccaatcaataaagaagataaaaattccgataaaaatttgattctaaaaaatttcaaactatacagataaactgcgtatccccatccaccaataattaaagtcacaggcaaatcggtcatctttccgccgaataacaccatgatcgttccactgataactgccgcgctaacgatctgcaaccagacaggaaagaacgaacggtctcggtcgattgcctgcaattcactgtaaagttcttctaatgttagttctgaagcaacatacttacgtgaaagatcattcacttttactactttttctaaattgatcgaacggttggtgatttgttccattcgaatggtcgaggtacgatcaagaccaataaagagaccagtctgcgtgacatagctgaccaaacggaaatttccagaagctaaagcaattcgactcatcgtatcttctacccgatacatctctgcattgctttccatcatgattttcccagcgagtagacaagtgtctagcagcagatctaattcttttcccgtcatagcatcttctccaataattgattgattagttttattttactacaaaacatatcggaagcgtaaagaataaaaaaacttgaggaaggagtgaaagaggcgtatactgtttttgtatcgcgggtgtagtttagtggtaaaatcccagcttcccaagctgatgtcgcgggttcgattcccgtcacccgcttaaaagaggctgtgaaaaagctgtcctgcatcaagtaatatgaatagtcaagcaaaaaagcttcttatgtttttgacttggttggacttattaccgcagatgcaagcttttgaacactgtttaccaagaggtcgtacagaagccgtttagttttgagtattaagaaaaattttttgaatgataataaataccttgtaaatagtgttttgtgattgagtagagacgatgaatccgtctctttttttgtattcttaagccgtctaaaaactggttttatttttttactgtttctatttctttccagtatttatttataggggaacatatgttaagatttaggggggctgttagtaaaggagtaaagaaatgagcaaaaaaacaaccaaggcgatcgtggggatcgtcgctgctgtgattgcaggggcactcggtatttccaccacacaaaaagattcagatatcttccaacaaattacaaccatttttgattccacaccgcaagcttctcaagtagcggatgtgccagaatatgatggaaaacatcaagaaatagaaatcaatgggaatcagccggagtttacaaaagaggatcttagtctttccaaagggacatgggaaagctattcaaatatagacaaattgaacagagtaggacaagccaatgcgatgttgggaaaagacttgtttcctactgaaaagagagaacctttgtatattgatccgacaggttggaaacaaaagaaattaagtgacggacaatggttatacaaccgcagccatttgattggtttccagttgactggtcaaaataataacattaaaaacttaatgacagggacacgttcgttgaatgctccgtacatgcttgcccacgaaaatgatattgcggcatatatcaaggaaacaaatcatcatgtacgctatcgtgtcactcctcatttcgagggaaatgaactggtagcaagaggtgtgcagttggaagcagaaagcattgaagacaaaaaaattgaattcaatgtctttatctacaatgttcaagatggctacaccatcaattatgagacagggcaagcaacgaaaacgaaaaattagtagcagcaattcgaattttttatgaactttatgaaaaaattgtgtaaaaacatactttcaaagaaatatagcgtatactttatggaaagagggcttttgaaaaagccacagaaaaaaggaaaaatcagacaaatcgtgtttcttaatttattcagaagtttggaatatttgtttgtagttttccctttcttcgagtaaaataagggtgtagaaggtaagctggaattaccttgcgggaaagaggtgtagaatcatgggttttacagatgaaaccgtacgttttggttttgacgatagtcgcaaaaaagaagtgagcgaaacattagcgattgtttatcgggctttggaagaaaaaggctacaatccaatcaatcagattgtcggctacttgctttctggagacccggcctacattcctcgttatcgtgatgcacgaaatttgattcgccgtcacgaacgcgatgaaatcatggaagtaattgtcaaagactacctctcaaatcatggagtgaatttatgagagtaatgggcttggatgtcggttctaagacagtaggcgttgctgtgagcgatccctttggctggacagctcaaggagtagaaatcattcgaatcaatgaggcagaagaagagtttggttttgatcggttgaaggaattagtggcgcagtacgaagtagaccgttttgtagttggattacctaagaatatgaacaattccatcggaccaagggcagaagcttccatgtcatatggagagaagatcaaagaactattctccttgccggttgattatcaagatgaacgactaaccactgttcaggcagaacgtatgctagtagagcaggcaaatacttcaagagcgaaacgaaaaaaagtcatcgataaattagcagctgtgatgatcttacaaaattatttagacggctcaggtaagcaattattttaataataaaagaaaagaggtaatcttatgacagaacataaccattcccacgaccatgaaggacacgaacacatcacattggtggatgaccaaggaaatgaaacattatatgaaatcctactaacagttgacggacaagaagaatttggacgtaactatgttcttttatatcctgctggtgtttcagaagatgaagatgtagaattacaagcttatgcatacatcgaaaacgaagatggaacagaaggcgagttagaacaaatcgaaacagacgcagaatgggacatgattgaagaagtattcaatacattcatggctgaagaagaagaatagaataaaagaatttatatggtgcaagaaagctggactctctgaaaaggagagcccggtttttttgtttagcactacatttctttaaaaagtagaaaagctttcgaagcctcgttcgtttcttttactgtataatataagcaaagagtaaaaatcgctaaaagatataaataagagaaaggatatacaagatgatatgattggtctgatttattttgtggtgatcgttctggcaaatacagttggcgctatttctggcatgggcggaggcgtgttgatcaaaccgattcttgatcttatcggtgcccattctgttgcaggtatttctttttactcaacggttgcggtattcacgatgtctattgtttcgacagtgcgacaagtatcaagtgggaaatcgctgaattggcagattgtcggttgggtatctggtggagctgtagttggaggaatagccggtaacattgtattcgaaatttttttacggttgtttgaaaatgaaaagcatgtgcagctgatccaaattttcttgacggtattgaccttggtttttgcgttcttctacaccaagcatcatcagccaaaatttcatctaacgtcatggatttggtatcttatatgtggggggatcttgggctttttagctagctttttaggtatcggtggtggacccatcaatgtttcattactgatgctgatgtttgccttgccaataaaagaagcaacgctgtattctctatctacgattttcttttctcaactggctaaattagtaacgattgcttaacaagtggctttatgcgctttgatttatctatgttgttttatattatccccgctgctgttattggaggtttgtggggagcaaaatttagcaggattttgtctccaaaaaaagtgacctttatttttcaagtaattgtcctcgtggttcttttggtcaattgttacaatgcctttgtcatcttacaaacattaggagaatctagattaacgcaagtcaaaatcactgaaaagtctttttttaagtgaaaaaaggagtatactgtgataaaaaaattcatttaaaaaaataaaaattggctggtgatttggatgttgcgggaaatgcgtttaggagatgcagaagcactacgagaaatcaatgcggaacaattaggatatgatgtaccattaaccgttacggtgagacaaatgaagaaactgttgaaggagccagaaaaaaattttttcttggtctatgaagatcctacttctaaaaaagcagctggctatgtacaagcggagtcctatgaatcgattttcagcgatccgatgttcaatattatggcacttgctgtgtctaaacatgctgaaaaaagaggaatcggaaaggccttgatgactggcgtagaagaagaagcgaaaagacgaggaatatcagcaataagacttaattctgcagaatacagagtagaagcacaccgattttatgaacgcatcggttatcattccgataaaatgcaaaaaagatttttgaaaatcctgtaaatttttatcaaaaaatacctggtcatcaagccgatacttgatgatcaggtattttttttgactaagaaagtaattgcatcaagaaacctgagatgatcaaaacgatggcaccaccaagccgattgcccatttgagcaaaagcaataagttccatccgattagctgcagataagacagctacatttcctgtaccacccatcgagttgttgcataagccagcagtaatagttgattcgattggatataaaccaaacaaacgaccgacaaatcctgaaactactgaaatcgcgataacacttgtcaaacataagacaacaaattgccatgtcaaagcagaagccaatacatttagattcaataacgcaataccgataccggcaagaacagctgctgtcaagtttttgacaatcaagttgttgaacatgatagctgcatcttcgtaatattctggtaataggtttgcgattttacagataacaacgataatgatcatgaatgcgtaagcatggactttaggaacaaaatagttaccgatttgtcctaagatgaagaaagtcaatgataccatcaaaccgacacctaattgtggaatggaaggttttacatttctaggttttccatcgccaaggtcgcctttttccattaatttaccattaccgttgaattttggcattgattgtcccgcacgagcaactaacgctgcaccaatgatagctaggacatttgtcattgctgtcgcaggaatcaggcgggaaatgatagaagaagcgtccgtacctaaaacatttgcataaatcgttgataaaggtacagctccggctccaacaccaccagccattgcgggcaatgagatatataaaacggaatttgcaaaaccatttccgataagcatacctacgagtcctacggcaaaaaaggagacgaccattgaaataagtgcaacgggaataaaacgaacagaagctttcatcaatagattacggttcataccaaggatgctaccagtaatcaaggcagcaatataaaagtctaaaaagcccatattgctgacaaagttttctgtggattttactacatactcaggtaagatcccaaatgtagcaatcgcggcagaggcaaagatcgcaaaaacggagccaccacctaaataacttttgacgatagggatttttgttccgataaaatgaaataaattaccgaaaatgaccaaaacagcgattgggccaatcatattcgtcggtaattttcctaaagccattgcaatgatcaggacaaggaccatgatcaaataaaggggcaaacttacgccggtaatttttgttgaccaaaacccttcttttttcttttcctcaactgcagttgcagttgttgttttttgtgccatttttacagatcctttcttattctgtatcgtatgaaaaaagccaaagagaagcggcaaaagagcagtagttggctggctgctgttttgccgcagtcgcttttttctttttagacgtcatacaaagtttctgtatgttcttttactataacaatcttaatcttctaaagatttatattcaggaacccatttagcagattcaacagcttctttgatatccgtgatttcttcacgattcaatttttgtgcaacaactgattttgcgacagtttcagcaatcgtttgagagaattcagtgatttttgctactggaggcaatatagctgctcctggttttgttacatcaacgattccgcctaatgctcgactagcttgagaaatgatttcagcatttactcgtgtagctgttgaagcaatcaaaccaagccctaaacctgggtacatcaacgcattatttgcttgaccgatttggtaagttacaccgttatattccacatcagcagcagggatacctgttccaactaaagcttttccgtccgtccattcaatcaaatcttttgcttttgcttctgccaattttgttggattagacaaaggcatgatgattggacgtggggtatgagccgccatttctttcacgatttcttcagtgaatgctccaggttgggtagaagtaccgatcatgatcgttggatggattgcttttacaactgcttctaagtttgtcaattcatcagcattagtgaattctgagcgtttacgagcgaatgggatttgaccaggagtcaatccttttgtatcttcaaacaataaaccctgtttatctacttgatagaaatgttggcgtgcttcttcttcaggtacaccttgacggatcatttcatctaaaaggatgtttgcgatacctacaccagcagtaccagcaccaaatgtcaagatcgtttgatctttcaattgctcacctgatatattcaatccacctaatacaccagctagtacaacgattcctgtgccttggatatcatcattgaaagtagtgattttatcttcgtatttttctaagatcgttgcagcatttcctcgtccaaaatcttcccaatgtaataacaattctgggaataattcagtagctgattgaacgaattgatcaatgaattcgtagtaagtttcgccttctacacgagcatgacgattccctaagtataatggattattcaataattcttcgttattagtaccagcgtcgattgatacaggcaagacttgtgcaggattgataccagccgcagcagtgtagaccatcaatttaccgatagcgatgtcaacaccgttcacaccccagtcacccatacctaagattccttctgcatctgtcacaacgatcaaacgaatgtcgcgtccacctgctgcgtttttcaaacttgctttgatattttctggttcgtcgattgaaagaaatgcagcatcttgtggtttcaagaaaatttcgttgtattgttcgattgaatccgcaacgacaggatcataaacgacaggcatgaattcaactaaatgttcgcccatcaatttataaaacaatgtccggttcgtattgaatagattcattaagaagatacgtttttccaaatcggtctgtttgcttaagtattgaccgtaagcttggacagattgttgttccaatgtttggacagtacttggaagcataccagtgattccgtattttgcccgttcttcttttgtaaaagctgttcctttatttagaaaaggattatttaataagtttagccctgtaagcatgaatgattcctcctaagttttaatacaaacgaagtataggagtcagatgaggatatagtcaaaaagagcaggtataataaattttatttatatgagtaatagagtcaaaagaaatcaaaatagcggtatttgttctttttatatcaacaatccttgcttgattactatgcgtatctcttatatgctaaagaaagaaaagtagaagaataaaagatatgttaataaatagaatctctgaagaataaatcacgtgatcgtgacgataaagttcacttacgtcaggtgataaaaaatacataagtagaaaactaagaggaggatcagaaaatgaaagaagttcaattgatcagaaaaagcgaactatcagaaggtggttgcaatgcgtgcggcgtagtagaagcaacaagctatacattaaagcttggtgccaacaaagcgataatctctgagttgacagtaggcggtcttgtggacagtctggcgcttgctgaaggttttattggagaagatatttatgagatgttttcagaaatccgtcagttaaaaaaaggggaaaactgcatagaggttcatcatgagagcccgaatgtgagattcaaacgtggtgataatgagatgatcttcaataatcatgtgtccgatcacaccgagctatatggaatcgtgaatcaaatactaactgagctttttggattgggaccttatgcgttcaaggaagaaaacggtaatccaaaattaaacgaagaatggcaagaaacgattgaaacacaaagaaacaacccgcacttatttcaataggcatccacagtatttcgtaaaagggactttgacacgacttttgtcaaagtcccatcgttttttatctatttgtgttctaaacatttctttcagagtagtaacaactggaatgactgaaatgtaaacagattatttgcctgtatcaatacggaagagtaatataaaatgtgtaaacgctatcatattattcattcaattttttatagagggaaggcattgaaatggaaaaaacgtatcaagcaggtacaaatgaaggaatagtggattttatcaatatggaagatttagaaatagccgcttcacaagtgattccagctggtggttatggttacatcagcagtggtgctggcgacttatttacttatcaagaaaatgaacgggcattcaatcatcagctgattattcctcatgtattaagagatgtagaattacccgatacaactacacattttgacgaagaaacgctgactgcaccaatcatcatggcaccagttgctgctcatggcttagctcatgtgaaggcggagaaagcttctgcaaaaggtgtagcagattttgggacgatctatacagcaagttcttacgcttcttgtacattagaagagataagagaagcaggcggggagaaagcaccgcaatggtttcaattttatatgagcaaagatgatgggatcaatttggatattcttgaagtggccaagcgtaatggagcaaaagcaatcgtattgacagcggatgcaacagttggcggaaaccgtgaaacagaccgcagaaatgggtttaccttcccactgccaatgccgatcgttcaggcttatcaatcaggagtaggccaaacgatggatgctgtgtacaaatcttccaaacagaagcttagtccaaaagatatagaatttattgctgctcattctgatttgccagtctatgtgaaaggtgtccagtcagaagaagatgtctatcgttcattagaatctggtgctggcggaatctgggtatctaatcatggcggccgtcaactagatggtggttcagcagcgtttgattcgttgcaatatgtggcagaagcagtagataaacgtgtaccaatcgtgtttgacagcggtgtacgacgcggacagcatgttttcaaagcaatcgcatcaggtgcagatcttgttgctattggcagacccgttatttatggattgtctttaggaggaagcacaggagtccgtcaagtgtttgatttctttaaaacagaattggaaatggtcatgcaattagctggaacacaaacagtagaagatatcaaaaaaataaaattgcgtgagaatcgttttatttaagatacaaatgacgaaaacaataggagtgcggcagttgatgccgtactcctatttgtatgggtcagagaagcattaatagaataagttgaaatgaaaaaaagaaaattgaaatgttttttcatacttaataaaaaaataagaatattcatgtaaacgattttattgcttttttctctttttatacaaaaagggacagaatttcaagtaagcggatgaattcatgaggattttttgcatgctgtctctactatacttaggtcactaagaaaaaggagtgatttattatgaaaaagaacatgattgggacattattactttcaacacttcttctaggcggcttggcaaccccagcttttgctgaaggtcaagcaacttcaaaaggagatattacctttactgagccaacaaatactgtcgtaccccttgatcctaccgatccttctaaaccagtagagccggcagatccggaaaatccaggaactggccagacaggtcctttaacgctggatgtagttcccgaattgccgtttggtacacacgagattgaaagcggaacaaaaacatatcaaatagacgcttcaaaaaatgatacaccttatcttcaagtatcagatcgtcgaggtgtaggtgcagtcgggcaagcgcaaggatggaacgtgacagtttcgtttcagattttgtaaacggttcacaagttttgcaaggggctgaattggattttgggacatccactgtgaaaagtacctcagataacgaagccactgcaccaactagtcaagctgtgactggattaagtaaagcaagtgcagcgacaccaatatttacagcagcaaaagaccaaggtctaggaacatggctttctgtttatgatccagcaaatatcacgctgaaagtacctaaagcagcagctggaacattcacggctgatttgacttggaacctcgtggctggcccagtagcatagaatatgaaatgaattcaacaaactgcggtgaaaatactatgggtgaagaatctttttaccgcagttgttgttgaaaggatgtggtggacaatgaatcaaagtaaacgactgtttgtttcgtttttttctattttaagtctatttttcatttttccgtcaatcagtcaagcagaggattcagcaggagactttgggatcaaaccggtatttccagagaatcaaatagataaagcaatcggttattttgatttattagtggcaccggaacaaaatcagacactggaagtaattatcagcaattctttagatcaagaacgaacatttgaggtctctgttaatccggcggtaacgagtgatggtggaacaatcgattatagtcaaaaaaatccaacgctagatgggaccttgccgtttgatgtccgtgacgttttgaccgttgccataaaggaagtcaatgtaccagcgcatgctgaaacaactgtacctgtagaagtaaaaatcccagctaaaagctttaagagacgtgtattagcgggtattcatgtttcacctaaagaagaagctgaaacagaaaatgctacagaaggtgcacaaataaaaaatcgtattgcttataatctcgcagtcgttttacaagaaagtcaagagacgatagaaccggatctgaaacttttatcaggagatttgaacgaggtcaatgcaaagcccactgtccagcttcgtttccaaaatcctcagcctacgattatcagcaatttgatatttacgagcaagatctattatgaaaatcagctttatattgaaaatacgtctaatgcatttttagttgcaccaaattcgaattttcacttgaatcttgatttagctggtgataaagcaaaagccggcgattaccgcgcagaaatcatagcaaaatcaggtgacagtaatgaatggcgatttacacaaaactttacgatcaaaaaagaaaaagcacagaaagtaaatgaaaattccgtttttgcagtacaagaacaatctttcccatggctttatgcaggattggttgctgcagttcttgtattactgttgattttgctgtttttgtggatccacaagaaaaagaaaaaaggagaaacaacacgatgaggtgatttcgttgaaagcatcaatcttattaggagggattattgcaagtttgctgttcttcagctggcaagagccagtccaagcagataccaaaagttcaggcacgattacattttatgatctaagtccagttccgcatccaagtggttcagtcaatggcacatcaaaacagcagacacagccatcgatttataaagaggctaatcaacatggcgtatttccggagacgaatgaacaaaggatccgttttctttatttgatcattggtatagaattatggcttcttgtgtggttgttgttatggagaagaaaggaaaaggaggatgaacatgttgctacaaaataaatttacattttttcgctccttcttttttacttcgctttttgttttaagtatatttatcttttcaccttcggcagaagctgttggagcaacgcctcctaccatttcttatgatccgtacacatacgaaaatatcgtacctccaaatggtggacgtactgcagtgaatggcgggaagcttgtccaactaactggggctaaccagttgcctaaattgactgctacttatttaaacgatggttcaaatgatccttggaaaggtggcacggtccgttttcattgggaaagtcatgtgaaactaacaaatgtacttgatttggtgaatatcactgcacaaggttttgccttcgttgcaatcattaatttaccggaacatgtatcaagcagtgatgtattaaaagcaattgactggaacaacgcctacttgtatattgccggtgcccccatcaaggttactagcggaagtttattatcagcaggaagccatactttacgttttgggatgggttcgtgggatacaaatactctcctgccagatatcatcgctattattacgcgaggcgagttcaatgttgacgatgtcccgcttcaatttgatattacagctaatgtcgcgaagatgacagaaaacggagataaatatgatacgagtccaaacaaaattttgaccaaaggtaaattacaaccttctatatctaaaaaagctattttttctgttgatttttatgactcgaataatattatccaagatcgtatgttcaattcgatcttagctccagctgcaggtagattttatcctaaattaactggtggaaaattgaatccaggagcgtatgcattttctgcaagtgcagagataaatacgtggaatagttacatttcaccaagtgattcaacaggaaaatataatacatttgctgatactacagaatacgtggatgggaataaccagaaccttccaggctcaaccaataatcgaacactaacgatggggttgactgaaggacgttttgatcaattaccgtctactcgctttgatcgtgtagtcaattattttacaggaaaaaacgtcacacaaggagcagcgctgactcatactccagcaagcacaagtggattgaatcagtcaaccaatattgtatatagcgggaaagatgcgcaaggtggattgctttctcccgttgctttaaaggtattggagcagtataagctagacggtacggttttaccaacaaatttaacagctgatagtcagtggggaaagctcctttctcctgcgccgtaccaagtcatggccaattggtcagcaactgaattaaaaacggggtcgatccattacaggctttattcgaaaggaacccaaaaattagcggcaggatggacagatcaacttttccaaacgatctcatcaaataatggcggcacaactacagctacttctacactacctgcattggcttcagggcaatattattttgattatcgcttggtggacgatgtacttactaacctgtatccttcttttgcgtacaaatggcagtctgaacaagcgggaatcaccactcttccccaaataacagtggctaattttccatcagtgagtgcagacagccagctaaaaaatcttagcagacaaccggatgaaggaaccccattatctgcactatcaggggatacgatacaagaaaatgtgacattcacgttgacaaaatctggggatgcgatcaccgacaaaaaaatcacgatctcacttccagaaaatactacttatatcaatggtaccttaaaattaaatggtacaactgtcgcagataccggcgttcaacaaggagtatctgtcccagcagatttattgagcaaagtcggcgatactattcatcttacttacaactatcaattaaatactgtagatacttctgtgcaatctgtcagcataccgacaaaggcagctgtactttctagcaatattacattagcagatggtgttaagcttcctaatccagttgtccaaacatcttccaaaacaattcttgtccccaaacaagaattgacattagttgatgtaccagatgattttacatttggcaacgatctccccaaaccgttgaagacaagttattatgaagcaaaaggcgatttttcttttgatgtacgggatactcggcttccaagcacgtctccttggcaactgacaggtacattgacttcttcatttaagaatgatcaaggtcaagaattaagcggaacaaaattgtactttaatcatgctggatcaaagcaattgatccaataaggacaaaacacgatgatttatcaaagtgatggcacagctaaaggagaggttctcgttgactttcccgataccgatggtttactcttagaggtaaatagcagtacgaacgctcaacctggcgtaaggtatcaaggcacgatcacatgggaactgtcagctgggccaatcagctaagtgatcagaatttgtatggatctgtgacaactgtcgcagatcctctttttcaaggatgagaaggaaacttctgctgttaaaatcagaaatgcttggaggagtggacttggaacttttcagtttgcttgaaaaaaatgaacaacggcaaatcaaactttttcaacttttattagaggaaaaaggagagatctctgttaataacgtactagcccgcttatcaatcgatcggtctaccttgaaagaagatttattttatttacaagctagtttggaaaacatcgaacaactggaaatcgttatccaagaaggatacattttattgatcagacatggcaatatagcagctatcgatgtttattatcattgctatttgcgctattctacaaaatatcaaatccttctttatctgttagaatatggctcatttgatcggcagaaacttgttatggaacttaatatcagttcggctactttgtcgcgtagagtgaaggaattaaatgattctttaaaagagtttcatttgaaaataaaaagcgggcgtttgactggcccagaaaatcaaatccgctatttctattttcaattattttggtttggtcgcccctaccttgaaaataaaaaagaatacagcgatttatcaggaaacacttttttagatctgctacaaaaagagttcagttttgccattacagaagaagggcgactgaaatttgaaatatggctttccattatgaagaaacggatgcgctgtacgaaaaaagctaaaccagattatagtaatcttcctgttggattgtttcaaacgacacaatttttattggagcttcatacatttttgacccgttatttctttcaatatgcctttccttgggatcaaaacgaaacgttggttttttatcttttcatgatcagtaactttacattagatacacataattcacatgttcaggaatttttgataagcgaaaaatactaagatgacgtagtggctcaattgaatcgaacgtttaaacaatcgatagaagaatatttttctttctatgcttttccagaagagatttcgcaaaagattgcgttaacagtgatgcaaaatcacgctcattttgcctattttagaggatggatgaatatttttggtcaagaaggattgaaacaacggttaactgaagtagaagataaacaattccttgttttatgtgaaaggctggtcagacaaacatttgctattgtggattttactgaagcagacgaggaaaatgcccgttttgaattatttgctcgctatgcatctattttacgaacgctaatcaagcaattggaattgcgtttgcaaattgcttatgatcttccgtacgaaaggctaatggcggatatcgtgaaagaaatcattcaagaacagttgttgaatacgatcaaatatgatttagtggaatacgagaaagacaagcaatatgatgttattttgactagccaattgaaagaatacccgtcacagaagtccgctaaagtttttgtatttacgagtaatgaatttaactatgattttccctatttgaaccaatttttaaaagaatgctatttagaaaaattgaatttaaggatgaataaaacatgaaaatcgtgatcattggtgcttcccatgcaggcatcaccgctgccctaaatctacgcaaacttcaaccggaggcagaagttctgttgatcgatgaaaatcacaaagatggattaggctatgtttcaaatgggatcaatctttatttagaaggaaagatacatagtttagctgaagctgcaaacaacgagcggactcttcaagcaagtggtgcaaaactgatcaccgaatggagagtaactgaacttgatccagacaagcatcagctcatcctcacttctgaggaaggaaaaaaagaaaccctaacctatgataaactaatcgtggcaacaggttcatctcctgctactttatataaacaaattgaagctgaaaatgtctacacctataaaaatctagtgcaatctaaacaagtacttgccgctttgaaagaagcaaaagaagtagtgatttttggtgctggttatattgggttagaattagcagatgctttgagaaataagggacatatgattcatttagttgattacatgccgaatgttttatcaagatatttcgataaagatatgattggcagttttcaaaatcagctgaaaaacaagcaaatcaactttcatccaaatgaatttttgattgattggaaaaaatcaggagaagaagtagtatccgtacaacttttgtctcaaacactgaaggcagatatcgtcattttttctgctcaaacttgtccaaatacgtcattgttaaaagacaaagtggcattgtatgaggacgacactgtgatggtcaatgaatacctgcagacaagtgattcggatatctatgcgattggcgatatcgttccagtcagttttgacaaaaaagaacggcatctctttttgcccttagttactcgagctgtacatatggcgagagcggtagcgttgactttgtgcgagcagccgactgcttatgatctcaaacaaaagataacagcaacggtcattaccgaccactttttaggaactgttgggttgacagaagacgaagcaccatttttggaacaaagtgcctgttcttgttcaggagagtttgacctatttccacaatactatgaagaaaataaaacagtaaatgcaaagctgatctatcatccagatacattagaaatcattggcggacagctgataagccaagaatttttattatcagatttgaacttgcttgctgatatcgtgaaacaaaaaaccacgattccacagttagcagttgaaaactttggatttttggctgaatataccccacgttttcactatctcaatgagttagcttttaaagtactagctaagagagcaaatcgcaatagagtagaaaaaagaccgtgagaaacatcacggtcttttattatgtgaaatgctatttttataataaaaaaactgaaaactactaactaaaaagcgtttagacatcataagaagagataataaaaaagcgaaaatgtattttgagcataatattcgccaaaaatttatcaagtgataaaattattgtataaaataattatttcaagaggaggaattaaatgtttttagcattaaatgaaattatgcattcaaagttacgttacgcattagttgcaggggtgatgtttttaatcgcctacttggtattttttttgaccgggttagcttatggcttagctcaagacaatcgaacggcggttgacaagtgggaggcagattcgatcgttctttcgaaagatgcaaattcaaatctagggatgtccatgattactaagaagaccgcagaagaagtcgaaggtggaaaagtggcctatcttgcccaaactccaggagtcgtgactagtaaagacagtacagatgaaggaaaaatcaatgttagcttctttggtatcgataaagatcagttcatcatgccgaatcttgttgaaggaaaagcttttaataacgatgatgaggcaataggcgatagtagcctgaaggaagaatatggtctagccgtaggagatacggtcaagttatctggtagtgataagacgtttaaactaactggttttacggatcatgccaagtttaatgtttcaccggttctttatacgaccatcaatgcttaccaacaaatccgtttcgaaaaagaagacacaagtgagaatgcacggatcaatgcaatagttgtcagaggaaaaatcaacgatttacctgaagacttggaacagatcaaaatttctaaattcatcaatgaattacctggatacaatgcacaagtattgacttttgggtttatgattggctttttgattgttattgcggctatcgtgatcgggatttttatttatgtactgacgatgcaaaaaatcaatatctttggtgtaatgaaagcccaaggaatcacgggaggatttattgcacgctctgtagtggcacaaacattcattttatcctttgttggtattcttcttggtctagtgggaacagtgggaacatctcttgttctacctgatgcggttccattccaaagcaattggctattttttggcgtcattagcttgttgatgttggtagtggctgtgttaggcgcactattttctgttcggacgatcgtgaaaatcgatccgctgaaggccattggataagaaggaggaagaacatgaaagcaatagaatttaaagaagtagaaaaaagtttccaagatggcgaccaagtagtaaaagcattgaaagaaacaacaatgagtatcgataaaggggaatttgttgcgatcatcggtccttcgggatcaggaaaaagtacctttttgactttagcaggcggattgcagacacctagcagcggctctgtatttatcaatgatcaggaattcagtaatcaaaaagaaagcgaacgcgttaaactccgtttcaaggaaattggttttattttgcaagcatcaaatctggttccttttctgacagtaaaaaagcagttgttattagtagataaaatcaaacatgaacatcggcaaaaagaagcaaaagaattatttgagcagcttggcgtggataagctgatcaacaagtatccagaagaactatctggtggtgaaagacaaagggtggcaattgctcgtgcattgtacaatgatccgtctattattctagcagatgaaccaactgccagtttggattcagaaaaggcaagagaagtagtcgatattttggcaaaagaatcaaaagaaaaaaataaagcaacgatcatggtgacgcacgacacacggttgattgacaaatgcgatagaatatttatgatggaagatggtgtattgaaagaaaaagaataaccaaaaagtaggtggaaaaatggtccatcgatacaataaagacacgcaacaaaaaattttaaaagaagcggctgacttgttcatgtccaagggctatcttggtacttcaacaagagagatcgcacaaaaagttgggatcacccagcccaatctttatcactattttagtgataaagaaaagttatatacagcagtattagaaaagcacttagaagatgttgggaaagcgttgagagaaatcgtccaaacaagcgaaacgagatttcaagtgacgttgacaaaaatggctcaatttttgattgagacgcatcttgttgatttatttctgatgcttcacgaccttgaaagcaatctttccaatgaaacgagagatcatcttttatttctatggaagaaaaattatcgtgaaccatttgaagaaattttttcaacaaaccaatccgtgttaagaaacgggattaccaaagaaatcgcagcaaggcattttttcttagtgttggcaccgtacatcactcgatcaaaaagacctgtagaagaaccgctaaatgtggcacaattgatcgatttatatttgaatggtgtattaggacaaacgtaaagctgttatatgtggagaaaaacagttaggtaaagaaacaagatatgacgaaaatcgttgtatcttgtttcttttttatacggctagtttttcatgcataaaattttgttattctctcataattatcatgggatattttatttattatttcattctaattgaatcgttatcaaaagggatttaaccaaaaagtagtttttgtttacttataaataacgtaaacaatataaaagaaaacgtttgcaaacagaattacagaatgttactatttagttgtaattataaagtcaatgtttctggtgcgtttgttctgtcggcgatctaggaggtgtttttatttaataacacaaataattaattatttgtagaatgaaagaaactatttatttggtggatgaatcataacgaatagacaaaaggaggtttcaaaatatgtcaaaaatgaaaaaaatcagtttagccgtaatgttattttcttcggtgatgtctgtcacatctccgttattaggacaaaaagactctgtctatgccgaagaaacagctcaagttgttccagcaaaagaataccggaatgtcatgtattatggagattggtccatctgggatggtgaagggaaatttcttcctcaagatattccagcggatcagctaacacatttgaactttgcctttttagattttgatagcgaggggaatctgacatttacagatgcagatgctgctgtaggtgcatctttagaacaacctggcgtaggatggaacacaccaagttctgggattttgaatgcaatccaagatttacgcggcaaaaataaaaatctaaaaataggcgtatctttaggcggatggtcaaaatcaggagacttttcagaagtggcagctgatccagtaaaacgtaaaaatctagtagaaaatatcacgaaatttattaagtataccaatatggattttgtcgatgtcgattgggaatatccagctgatgtccgtcagccagatctagtagataatgtaaacgatgaaggaacaccacatgccaaaccggaagacaaagagaattacatcacgcttttaaaagagattcgcgagtcaattgatcaacaaggagaaaagttagggaaaacatatgaattatctgtagcgcttccttcttccagagaaaaattaaatgatgggattgacattcctaaattattctctgtggtcgattttgccaatatcatgacctatgatttgaatggggcatggagtcccaacagtgctcaccatacggcactatatggcaatccagctgatcctaattatgaagaaggtctttctgtcgatcagacagtcaaatttttacaaaaagaaggagctccttccgacaaaatcgtgattggtgcagctttttatacacgcggctggcatgaggtagaaagcggggataacaaagagctacctggtttgttccaatcagcaaaagcaagcaaccaagatgccgatcaaacaccttcttacggtgccaaaaacaaaaacgatctcgtttcaggaaatggtggtagagctggcggcgtctggccttatcggaatatcgctgatttgattgatcaaacagcagacttaaaagaatattgggatgatgtagcgaaagcaccttatatgtacagtaaaataacaggagaattctttacttatgacaatgtcaaatctgtcagctacaaagcagaatatgtaaaagaaaatgaattaggtggagtaatctcctggatgcaatcacaagataaggaaaccaacagtagtaagagagacgagctgactaatgcgatcaaacaaggattattcggtgacgaaaaactgtcagaacaagaaataatttcctccccgttagcgattgatgtggatatttctacttatagtgaatatggtgcgaatggttataacatcactatcaagaacaacgagcagcttaacgaaacttctagtgtattgagtgcagtggaattagcccaagaaacaatcaaattccctaaactatatattccaatccattcagctgaaagcctaagtgccggagattacaaagctggaacagtaacgatagaaaatgggtatgtcgtgattgatttagcttctgtatatgacggtaaacatatcgagccagatgcttcttatgaatttagattaagatcaagtgatgaaaatccaacagtcgatcgaattggccatattgcgttagtccaaagaatcggagatgaaggagcggaaatcaatcggcaagtcatctatggaaaagaactgataccggatccatccgatacgcaacccccatctgtacccgaaaatctagctgtttcagatattcaaggaacacaagttactttgagttgggaagaatcaacagacaataatcaggtggcaggttattacatctatcgtgatggtcagcgtgtagcacaaacagctcatactcgatatacagatacaggtttggagacaaatacaccgtacacttatacagtcagtgcatttgacgcttctggaaatgtatctgagaaaagcttgccgataacgatcacaacgaaaagcgaagaccctgctccaggatacgaagaatggaacccagaaaaagcttatgtcaagggagacatcgtcacttataaagggaaagtttatcaggcaaagtggtggaattaaggggaagaaccaggttctaatgagtggggcgcatgggaactgattggttaaatttgctgtttatttgaaaacacggggctgtgacaaaacgtttgtcgcagctccttttttgcgtacttaagctgattttaagttttgacccttagtctggatctacgaggtgagagtcaagcatgaaaaaaataattggagcttttgtatgtgcaatcattatcattattatctgttttcaaatagatgtttttggtcaaaaaaagatagttgggcaaacagtcagcagtacgaacagtacggttacaaagacaaaggaatcatctgatgacacaaaacaagagacattagtcaaaatcggaaaaaatgaccgtacactatatacagatgactcgctaacgaccccattagcaactataaacggcggagaactgacggagtttctttccgaaacaaaaaatgcttatcagatcaagacaaatgatggctatactggatatttagccctcgaagatggaaccaaagtcacaaagaatatacaaacaaaaccgaaagagttatctgatgcagtgattgtattagatcctgggcatggcggaaatgatactggggcattaagcaatgatgaacaaacagaagaaaaggatataacattaagtacagccataaaagtaaaaaaggcgctagaggatgctggagcaacggtttatttgacccacactacagatgaattagtacagcttggagatatatgcgactacagtgaagaaaaaaaggcagatgtctttatcagcttacatgcagactctacggaatatgcgaatgaagcaactgggatcacgacatattattactatggacaagaggaaacattagcacaaacaatcgctgattccttcactgatctgcctctggattcaagaggaatctccactgggaactatcaagttcttcgagaaaatcttcaaccttctattttaatcgagatgggttatatgaataatgatggtgatttagaggaattagtaacagacagttatcagcagcagatcgctgcaagtttgacacaagcattgaccacctattttcagcaataaataaggaaagaggttgtgacagaagtggtcagcttcaagaaataagaaggaatttacgaaaattgcttctcaaatttttgtgaaatttcggcttatttttcgaagaagctacttctggaacaccgtttaagaaagaggtcgtgagcctgccgttcagctccgagtcacaaggagcaatttcaaaaaacagcttctcatgtttgatgaatattgtgacttgtgaccgaggagttggcaggagaacaccgtttaaggaaagaggttgtgaaaaagctgtcctgcatcaagtaataagaacagccaaacaaaaatagcttctcctatttttcgtttggttggacttattatcgcagatacaagcttttgaacaccgtttaaggaagaggttgtgaaatcagcgttctgatctgagtattagagaaacaaacggaaaaatagttcctcatattttgctgtttgttgagctaatatcgagggtcagctaattgaacaccgtttattcggaataagggactgtgacacgacttatgtcacagtttttttatttttttattagcttcaacgctttttctgtattggcaaagtgaagtttggcatatttttcaagcataggcatgccgcctttttctaatagttttgccgctatttgatcagatttcgttccagctcctgagggaagggtgattccagcttcagctgatgctttgtctaactcttctaaaaagctggcacgactgatgatagaagcagcagcaacagctaaatgatattgttctcctttagtaacgaagtacagtttttcttgcaagtgatttttttctaaacgcgcatattttttaaaatttgcttctggcgtaaactgatcaatcaaaatcgcttctggtttttctggtgcgatcttttttagcagcaaatggattgcttgattatgcaaagcgactttcatccgaacagcattgtattttggctggatctcattgtatttttctgggggcaagacaagtagtttgtaagggatagtttcttttaagacatcagcaagttggatgatttggctatcttttaactcttttgaatctcgaacaccaagtttacgtaattctgcaagctgatcacgtttcacataagcagcacatactgttagtggaccgaaatagctgccatttccgacttcatcgctacctaaaacggataattgactgatattttttggcaaagaagagaccgttcttgctggtttggcctgcttatcctgtgcctgtccccagcgctgagcttccgtttctgcgtttgccccttggaacatcacttttcctgatgtgtaagcagtgatggtcgtcccgtcttttttagcagcaaagatagtataaggaatctgtttatttaacaaataagagcgatagtgtgctttcatttgactaagttggtcgttcgttgctttgataatgacgttgctcataaaattctcctcgtttttatacataaatctataccgcaactcctgacttttcgttttctaagaggttgcgagacatagcatttttttaaagtttatcatataatagttaagtatgtgaaaaatatttgtggagaacggtgaaagaaccaacttcatggtacactaaataaaactttcatcaaataggaggaaatgattcgtatggcgcacgaaaaaacacgctacaaagcagtgattgccaaccaaacatatactattatcggacgggaaaccaagcatcatatggatatcgtaacgaagctgatcaatgagcagttagcagaattgaaacaattatcaccacaaatggataatgaacaagcagcgatcttgatggctgtcaatgcgctttcggatcaattgaagaaacaagaaagaatcttggagctagaagaagaaacagcagaattaaagaaaaaaatgatcaaatttacagagcttgaaaatcgcgtaaaacgcatggaagcaatcgagaatgaagctcgagaagtactgaaagaaaatggtcaagcagattatactattaaaaatcatgtggaagcacagcagattttaaatgaaaaacgaaaaggacaaatcaaacaaaaatcttctaattaagatccttttatcaaaataagaaaaatttaaaaaagttagaagagaaaggaacgtagcatgctgagtttgctgattttatttttattgctaattgcgtttttttctggagcacgtcgcgggtttgctttacaattcatatttgcaatcggatatgtgttgtcatttattgctgcccagcatttttacaaaccattagcaagtcatttggaattatacattccatacccagctgtcaccccgacatcaaagttagcattttttgatcaagtatttgcctttcacctagatgaagctttttatgcaggaacggcttttctgatcattttgctgattggctggctgatcacccgatttgtgggggtctttgtccatggattgacatatgtgccgatcttgagacaggtagactggattgcaggaggtatcctgtcactaatcatggcttacgttactatatttttgattttgcagttacttgcctttgttccattagatgtggtccaaaatcaattcggcgagcatagtttcgctcgttttatcgttgagagaacgccctttcttaccaacaagatgtatgagctttgggtaacgaatattttgaattaaggaaaatagggctagaaaatatttttttagaaaaacttttacaagaatgttttgttttttgtacacagtagtttatttaagaaggctgcgcaacgtatgtccggcacagcccttttttcatagtgaaagataaggtgataaaatgaataaccgaatccttgaaacattggaatttgaaaaagtcaaacagatggtcaaacaatttgtagtgactgcacaaggaaaagaagaactggcagaattggtaccagtgagcgagaaacaaacgatcacagaatggcttcaagaaactgaggatgggttgaaagtacaacgtctgcgaggcgggattcctataccaaaacttgaaaatatccgccctcatatgaaacggatcgaaatcggggcagatttgaatggagtggagcttgcacaagtttccagagtgttatctacgacaagtgaattgcatcggttcattgatgatctttctgacagtgaaattgaatttgcgcgtttgtatatgtgggcagatcagctagtcacgattcctgttttaagtcgccgtttaaaggaagcaatcgatgaagacggacgcgtgaccgacgatgcttctcctgagctaaaaatcataagacagaacattcgtcgcagtgaacaagctgttcgtgaacagttagacggaatcgtccgcgggaagaacgcaaaatatttgagcgatgcaatcatcaccatgcgaaatgaccgctacgttatcccagtcaaacaagaataccgcggtgtatttggcggtgtagtccacgatcaaagtgcttcaggacagactttatttattgaaccaaaacaagtggtggatttgaataatcgtttgcgtcaatatcaaatcgctgaacgaaatgagattcaacgtattttaagtgaactttctgcagaacttgttccacatcgtcaagaaatcatccacaatgcttatgtgattggtaaaatggatctgatgaatgcaaaagcacgatttggtaaagaactaaaagccatcgtgccgggaatcagtgaagacaatcatgtcgtcttgaaacaagcaagacatccgctgatcgatcaggaaaaagtagttcctaatgacatcgcaattggaaaagactatcaagccatcgtcattacaggacctaatacaggtgggaaaacgatcacgttgaagactttaggtctgttacagctgatggggcaagcagggttgccgattcctgcaggagaagaaagccaaatcggtatttttgaagaagtatttgcggatataggagacgaacagtcgattgagcaaagtctatcgaccttttcttctcatatgacgaacactgtagatattttatcaaaagtcaatgaaaaaagtctggtactatttgacgagcttggtgcaggaacagatccgcaagaaggtgctgctctagcaattgcgatcttagatgatcttggtaaaaagtctgcttatgtgatggcaacaacacactatcctgaattgaaagtttatggatacaatcgggcaaatacgattaatgctagtatggagttcgatgtggatacactaagtccaacgtatcgtttactgatcggtgtgcctggtcggagcaatgcgtttgaaatctccagccgattaggtcttgatacagatgttattaatgaagcaaagcagttgatgaatgatgagagccaagatttaaatgaaatgatcacagatttagagaatcgccggaaaatggcagagaccgaatatctggaaatgcgtcattttgtttctgaggcacaagaacttcatcatgatttgaaagaagcttacagctatttctttgaagaacgtgaaaaagaaatagagaaagcaaagaaaaaagcaaatgaagtcgtgtcagaggcggaaaaaaaagcagaaaaaatcattgctgatattcgtaaaatgcaacagcagatcgggcaaggaaatgtgaaagagcatcagttgatcgatgcaaagacccaattagcaaatctacatcaagaagaaacattgaagaaaaataaagtattgaagaaggcgaaagaacaaaaaacattaaaaccgggagacgaagtgttggttacgacttacggccaaagagggacgcttttacgtaaaaacgggaatcagtggcaagtagaaatcggtatactaaaaatgaatgtgtccgaagacgaactgacgcctgttgctcctcaaaaaaagccgacacaacgagttgtccatgctgtacgctctgaatctagcagtcatgtgccgaatcaattggaccttcgaggaaaacgatatgaggaagcgctaagtgaagtagatcagtatttggattctgccatcctagcaggttatcctcaagtgactattgtccacggaaaggggacaggcgcacttcgcaagggaattactgattatcttaaaaaccatcggagcgtcaaaagctttgagtttgcaccggcaaatcaaggcggaaatggtgcaacaattgttaaatttaagtaaaacttactaaaggtaagcagatggttcgctatccaaggatagaaatgctatactggtcatagattttaaaaatggaggtctttgatatgtcacaagtaattacagataagacatttaatgaagaaacagacaaaggacttgtattaattgatttttgggcaacttggtgtggcccatgtcgtatgcaggcaccgattttggatcaattggaacaagaatatgatgaagaagaattcagaattgctaaaatggatgtggatgaaaatccagaaactcctcaacaattcggaatcatgagtattccaacattaatgttgaaaaaagatggtcaagtagtagaaaaagctgttggtgttcattcaaaagaacaactacgtcaaatgatcgatcaatatttataaaagcttaaagcaaaaataagctgaggatgggactgaattcagttccgtcctcggtttttttgcggttgagttaaggttattcaaattaacattttttgagtataattacgttgtcaggctggattgtttttttgacagacatgctataataactttaattgaatatgaaggggagtaccagatgaacgaacgaatcaaaaacaaactagctttacttcctgatcagcccggctgttacttgatgaaagataaaaatggaacgatcatttatgtcggaaaagccaaaatattgaaaaatcgcgtccgctcatattttactggcagccataatacgaaaacggaacggcttgttagtgaaattgaagactttgaatacatcgttacagaatcgaatatagaagctttgctcttagaaatcaatctgataaagaaaaatgatcctaaatacaatattatgttaaaggatgataaaacctatcctttccttaagataacgaatgaaaaatatccccgtttggtgattactcgcaaagtactaaaagacaaagcactgtattttggaccatatccagatgtcggtgcggcgaatgagacaaagaagattctcgaccgattatttcctctgagaaaatgcaaacctagtcagacgaaggagccttgtctttactatcatttggggcaatgtctgtgtccttattatttcgacgtagatccgaaagtctatacgaaaatcgttgatgaagtgaaaaactttttaaacggaggacacgaaaaaatcgagtcagagatccatcagaaaatggaaaaagctgctgaaaacatggaatttgaaaaagctgcagaataccgagaccagatccgtgctatcgaaacaatcatgactcgccaaaaaatgacaaatactgatttactggatcgagatgtatttggttatgcgattgataaaggctggatgtgtgtccaagtgttttttgtaagacaaggaaagttaattgaacgagatgtttcaatgtttcctttctataacgaagcagaagaagattttttgacttatattggtcagttttatcaggaaaatgaacatttcattcctaaagaagtcttgattcctgatacgatcgacaagccaagtgtagaagctttgttggatacgaaagttctacaaccgaaacgaggcgaaaagaaaaaattagtggaattggcgaataagaatgcctcagttgctttgaatgaacgatttgatctgattgctagaaagcaggaacggacgatcggagcagtggaacgtttaggaaacgcaatgaatatcccgaccccaatacgcattgaatcatttgataactctaatatcatggggacgaatcctgtggctgcgatggtcgtattcattgatggaaaaccagcaaaaaaagaatatcggaaatataaaataaaaacagtcaacggaccggatgattatgcatcgatgagagaagtcatctatcgcagatattcacgagtgattcgtgaagggttgcctttacctgatttgatcttgattgatggaggaaaaggacaagtcgatgtagcaaaagatgtcttagaaaatcaattaggaatcgatattcctattgctggtatggcaaaaaacgataaacataaaacaaatgagttgctattcggtacagatttggctgtagtaccacttgaacgaaattcacctgagtttttcctgctccagcgggtccaagatgaagtccatcgattcgcaatcactttccatcggcagctgcgtagtaaaaacagttttgcttcccgattagacgaaattgaagggctaggaccgaaacgaaaaaaaatgttgcttaaagagttcaaatcattgaaaaatatcacagcagctacgatagaagaattacaagaaatcggactaccgaaaaatgtcgcacaaaacgtatttgataaattacatcaggaatgagaaaagggcactttacaaagaaagtaaagtgtcctatcattttaattacaacaacaagagagtatacgttttgttggtaaataataaatcgcttacatctggtgtcttaggatatatggatttattgaagaaggagtgaagaaatgttagaagtcaagaatcttgttaaaacttttgggaactacacagctgtcgatcatgtctctttccaaatcccagacggaaaaatcatggggctgattggtcaaaacggtgctgggaagacaacgacttttcgtttgatcttggattttttgacacaagaccagggagaagtgttatggaatggtcatcatcttggggagaaagattatgatatcatcggctatcttccagaagaacgaggactttatccaaaagtaacgattcaagaccaactgctttattttgcagaacttagagggaaatcaagaaaagaaattgaaccaaaaatcgatttttggatggaaaaatttcaggtaaaagggaaaaagacggataaagtaaaatctttgtctaaagggaatcagcaaaaagtccagcttatcgccacattgatccatgaacctaaattgatcattttggatgaaccatttagcgggttagatccggtaaacgcggaattactgaaagatggaatattggaattgaaaaaacacggttcgtgtgtcattttttctagccataatatggataatgtagaaaaaatctgtgatcatttgatcatgctgcgaaacggaaaaatggttttgaatggaaaagtccatgagatccgtgaatcatttggccgtacgaagttattcttggaatctgggttaagtcaacaggaagtagaagaaatcgaaggcgtgaaaaaagtgatccttcgtgaggataatacgttagagatcacattagaagatcctgaagctgggaaagaaatctttactcgtgcgacacaattcggctatatccctatgttcaaccagcagccgccaactttggaagagattttcaaattgaaagcaggtgaaatcgatgcgtaagttttggattattaccaaagatgtctatttaaaaaatgtcaagtcgatttctttcttgattatgatattagtccctttcatcatgctaggtattatttatgtagcaggaaactttgcccagcaaaatagtgatgtcaataaaatcggcgtattggctgataatgagcaaatcagtcagcaattgagccaagtcaaaacagatgattttgagttcaaagcagtggattctgaagaaaacgcacaaaaagacctttcgaaagaaaaaattgatgcttatttagtagtctcaactgataaagataaagtaaatgggacgctttatagcgaaaattcattgggacaaagtacacaactgctgatacaacaacaattgactggcttgcaatcgatgcttcgagcaagcgaattaggtatttctccagaagaagtggcaagtttgagccaacaggcaagtttgactcggcaaaaagtcaactttgattcaaaaggaaaaatgtcggtaggagaagataattcgacagtccaatatgttgtcagctatgtggcgacgattgtcttgttcattatcattctgacttatgcacaaatcattgcacaagagattgcttctgaaaaaggcacgcggatcatggaagtgatcctgtccagtacgactgcacaaaagcatttttacgggaaactaactggtgttttgcttgttgcattaacgcaaatggcattatacggcattatttttggtgtaggatacaatcaattcaaagatatggaaatggtcaagaatatattggacggtatctcattagataatttgattggaccattcttgtggtattctcttctatttatgatctttggcattttgattttttctgttttggcagctttatgtggctctttggtcaacaaagcagaagatacagcaaaagcaatcctgccagtgacttatttatctttaggcggatacatgcttgggttgatattaggtgcgtcagatccaaataatatcgttattcggatcacttcgtatattccatttttatcttcttatattatgccggttcgcttggcaaatgagacagtcggtatgggtggagcattgatttccttgttggtacttgtagccgtgacattcttattgatgatcttgtctgcaaacatgtacaaatcgaatgtactcgtgtatagcgaaggcggattatggagttcatttaaacaatcgatttcaattatgagaaatgaacgaaaaaaagcataaaatatagaaaaaatatagaaggaagctggacatttattgttcccagcttcttttttgtatagacctatttctatttttttattatattggatatatattcattgaaaatagcgtataacaactttataatgttgagtataccaatttttggaggcgttttaatggaccgctatttagatttactttcagagaagttccctacaacggaagatgtcatcacggaaatcatcaatctcgaagcaattttgcagcttccaaaaggaacagagttatttttgagcgatatacatggcgaatttcctgcttttgatcatattctgcgtatcggttcaggaaatcttaaagaaaagatcaaagaccttttctctgaacaaatgacggaaacggagatcagccaattcactatttttacggcttatccagaatatgtattgacgactgattggtacaaaaaacaagataaatcccagctgatccatcgtttgatcgatcttttacggtttacgacagtcaaatacactcgatcaaaagttcgaaaaggattgccgaaagaatatagctatatcattgaggaactcttgtatatcgatgatcgtatcaacgggaaaaaagactatgtaaaaaaaatcattgaacaacttgtcttgatgaaggaagaagaaaaatttttaacaaaacttgcgcagacgatccaaaaatctgtcatcgatcatttgcatatcgtgggtgatatttttgatcggggaactcaagcagccaaagtaatggatcgaatcatggatttttcctctgtagatatccagtgggggaatcatgatattttgtggattggtgcgtattgcggctctgaggcatgtttattgacgcttttacggattgccgcacgctacaactatttatttgaattagagaaagaatatggattaaatttacgtccattattttcttttgcccatcaaacctaccagaagaatcctgtatttacccctaaaaacaggaaagatctatctgaaagagaacaagaagaattagaaaagatccatcaagcactttctatcctccaattcaaatcagaacatcagttgttggatcgacgacctgaatttaaaatggacgatcgtaaattgttggaaaaaatcaactatgaagaatcaacaatcgatttagaaggtcagctctatgagttgaaagggacttgttttcaaacgatccagccagatgatcctaaaaagttcttggaagaggaacaaaaagtgatcgatagtttgatgtattcattccagcactcgttaagaatgcaaaaacacatgacgtttttgatcgaaaaagggggaatgtatctcacgaataatcagcatgtactgtttcatggctgtatacctgtagatgaaaaggggcagctcttagcatttgaattagaccaatcttatcgcggaaaagaattactgggattttttgaaaaacagataactgaaagcgcaaaagatttgactgcaaaagaagatttggcgaccgatttgatttggtatgcgtggagcgggccattttcgcctttattcggcaagagtaaaatggccacttttgagcgctattttctcacagagcctcatacgcacgtcgaaaaaagcaatccctattatcacttgcgagatgaagagtggttcagtgaaaaaattttggcagaattcgatgcaaaagaagaaggttcagcaatcatcaatgggcacacgccagtaaaagtaaaaaaaggagagtcaccgatcaaagcaaacggaaaagcatttgttattgacggaggtctatccaaagcttatcaaaaaacaaccgggattgctggctactcactattatgcaattcttacggtttccaaatcgtgacacattatccgttcttgcctattgaacagcaatttgcaaaaaaatctgatcaaacgaatgtaaaaaaagtaatcgagcagcagctcccacgcaaacttaatcgggatacgacaaaaggaatggaattacagcaacagattactcagctccaaaggctgttggactatcgaaaggacgattgagaaaaatgctagccaacattgctcaatagacaaaaaagcgactgcaacaaaaggcgtgtcgcagtctccttcggaattagctcaaaaaacggaaaaatatgaggagctatttttccgtttatttctctaatactcaggtcagggcgctgatttcacgacctcttggtaaacggtgttcaaaagccagtttctcggtattaagccaaatttatttaaaaatgtggaaagccattttcacaaaatttttcttaatactcgaaactaaacagctttttcacaacctctgattcacggtgttcaaaagcttgcatctgcggtaataagcccagccaaacgaaaaatatgagaagctatttttgtttgactgttcttattacttgatgcaggacagctttttcacaacctctttccttaaacggtgttctcctgccaactcctcggtcacaagtcacaatatccaacaaacatgagaagctgttttttgaaattgctccttgtgactcagagttaaacggcaggctcacgacctaatcagaaaaacgattaaaattcattcacaaagaaatcgaataaacgctgttcagatgaatctacacgatgagaaagttccggatgccattggacaccaaggattttgtgcatattatctttactttggactgcttcaatgagtccatcgttggaaaaggcgatggcttttaacaaaggagaaagatctttgactgcctgatgatgataggaattcacaaagtatgaatcagggagaaggtcacttaataaactgtccgaaacgattttgacttcgtgagtcgcaaactgcggggcagtgggctgttgttcgtgttttacggaccattttggatataatgaaagatcttgataaagtgttccctccaacacgacattcaatagttgaagtcctcggcagactgcaaaaatcggttttctttgtttcaatgcttccaagatcaatgcctgttcgaattggtctcgttgaatatttgtttccgtcagttttggatgagggtcttccatgtaaagttgcggactaacatcctgaccgcctgcaagaatgagtttgtcgattttctcaattagttgaggcgctgaatctggagacatgactggcagaataagaggcaatccttgagcatctaaaactgcatccacaaatccctgcggtgtatagcttacttgatttccttggaaagtatctgtcgctcgaatcagttgattcccggcaatgccgatgattggtttcatttttattccccctaaagtagactaattgtaacaaggatttaaaaaaatttaaactatgtaagacttgcccctatacttatctgttcttgctgtgttactatctgtaaagagaattttcgtgtgaaattcatgacgatagttgaaaatattgcttaatttgttataataaaaagtaagcagaaataaaaaggttgggcgtaagcttcaaggatctagttcttcaaggggtgagaaggacattttattgaaggggcctgcctatactaagttatctttagaggtacatactttcaatgaaaaaagaaagcatgtacctcttttttaaatcgaaaggaagtgaagcaagtgttagaagctttggaacaaatccgaaaagcagaagaagaaaatgagaagcgtgctcgaaccctacggcagcagttgaagacctatgcagaagaaaaagagcaagaattggagataatccaaacgaacagtcggcaacagctgaaacagttggtagaagaaaaagaacaattcgaaaagcaagaattagaaaaagaaaaaatgaaattgaaagcagaagcagacaaggtgcaagcaactttgaaagaccaatatcaaaagcatcagagtcaagcaatcggtgcaatcattgaaagggtgaaagaaacttatggccgtcactaagatggaaaaagtgaccctcatttcagataaaagaaatcaggagaggattttacaagcagtacaaggaatccaaaatgttgaaatccgggatctgtatcaaaatagaacaaacaaccagtgggtagaaaaatattttccagataccacgattattgataaagaagcaaaattaagcgctttaggcaatcggctgaaagacatccaagaagctatccaattcatacaacaccacggcgatagccgtcaaaagaaactccatttgaaacgtcaagaactttccttacaagacttggaagcaaattattccgaagaaaatttcatgaataaattagaagaagtccttgatttaaaagaaaagtgggaacagctaactgaaaaacgtgatcgtttagaagaagaggaagaatggcttcttcattggcaacagctggatattgctccaagtatgtatgcaagtaagacgaccatttttgagatggggactgtgagtgcagcaaattttgaaagtttcaaggaagaactaagtaagcttgatgacgtttatatggaagaaatagattatacgccaaaacaagtttatctttcgtatgttgctttaaaaaaatcagctgctgctatagaagaaattgctgggaaatacgggttcaataaagaaacgtatccttatgaacaaaatcctaaagaaaaactgcaagaaaccaaacagcaattgtccgttgttcacgagcaccaaaagaagataacgacagcgttaggtcagtgcagcggctatatccaagaatttgaatgggtagaagaagtcacacttgccgttgcagaacgggaaaaagtaaaagaacggtttatccatgcgacttatctgatcgttttgcaaggttgggtagatgcagaagaaaaacagaatttgatgcatgtgttaaccgaaactgtatcagaagaagatatatatattagtttcgaaacaccaaactcagaagagattcagcaggaagtccctactaaattgaaaaaccatccgcttatcgaaccttttgaattgctgactgaaatgtacagtctgccaaaatatgaagaagtagatccaacgccttggatgacaccattttatcttgtcttcttcgggatgatggtcgcagatgttggttacggattgctgatgctcattgggacaatactagctcaaaaactacttgttttaccacgtgggatgaaacgtttcgtaaaattctttgagattctctcggtaccatcgatcatctggggattgatctacagttcatttttcggacaggcattaccaaaagaactatttggcatccgcttgcctttcccaatcctatctacaacggatgacgtcaatacgattttgattttatccgtgattttcggtctgatacagatcttggttggattatttgtggcagcaaaggaaaatatcaggagaaaagattacttgagtgctgtcagtgatggatttgcctggcaagggatcctgattgggatcgttattgcattgattggtgccatgttgataaaaaatacagcatttgtttatcttggcgcggggctatcgatcattgctgctttatgtatcttaatcgtgccgattatccaatcgccgtctaaagtcaagggtgctgccaaaggagcgtataatctttacggattgacgggttatatcggtgatttagtcagttatacacgtttgatggcattaggtatttcaggcggaagtattggcgcggcattcaatatgctggttgctttcatgccgccagccgctcgattcagtgtagggatccttttgatcatcgctttacacgcactgaatatgtttttgacactgttgagtgcctatgtccatggcgcacgattgcagtatgtcgaattttttgggaaattttatacaggaggcggacgtgcctttgacccgctgaaaacggcggaaaaatacgtcaacatcaatcataagaaaaaaaataataaataattggaggatttttatacaatgatggattacttaattagtcaaaatggtggaatggtatttgcagtattagcgatggcaacagcgacgattttttcagggatcggttcagctaaaggtgttggaatgacaggtgaggcagcagcagcgttaacaacaagtcaacccgaaaaattcggacaggctctgattctgcaattgcttccaggtacgcaagggttgtatggattcgttatcgcctttttgatttttatcaatttaggaaatgatatgtcagttgtacaaggattgaactttttaggcgcttctctgccgattgcttttacaggcttgttttcaggtatcgcccaagggaaagttgcagcagcaggtattcaaattttagcgaaaaaacctgaacatgctacaaaaggaatcatttttgctgcgatggttgaaacatatgcgattttaggtttcgttatttccttcctattagtattgaatgcctaagcataaaggaggaaaagcagatgaacgccattgaaaaaatcatctctcagatgaatgaagcagcagagcaagaaagagcggcgttagagcaagaagagcgaatgaagatcgatcaaaactttgaacaaaaacgtacgcaaatcgaaacagaacatcaaaaacaaaaagaaaaacaaatcgaattacttgaaaaaaaataccgtcagcttaggaatcgccaacaagtagaagtacgacaagaaaatttgaatgcgaagcaggaatttttacgacgattgtttgcagatgcaatagctgaaatggagaattgggatgaatctgaacaaatccagtttatcaaaaattcattgtattcattacctttgacaggcaaagtagcattcattgctggagaaaaatcagcagcttatctttctcagacattgctggatgaatggaacaatgaacttccctttacgatggttttaagcgatgaatctgttgctggtcaagctggttttctgataaacgatcaaggagttcagtataattttcttttcagcagccttgtacaagatatccaaggaacgatgagttttgagattgccaatcaattattcgaataaggagggatcagtgtatggaataccacgaactaaatcccttgattcgcggaagagagcttgaacttttgtccaatgagacatttgaacggatgattcaaaccaattctgtcgaagcacttggtgaaatattgaaatccacgatttacagtccatatatctatgacggatatgaatatgacttcgaacagaatcttttaaaggagcagagccgtctatttcgctggttaaaggaatcagcaccggagcctgaaatcgtttggatctacacgatgcgctatactttccataatctgaaagttttaacaaaggccgagatgacaaatcaaaatctggactatttgtatatcgacgatgggttttattcattagaaaccttgaaggatgccgttcatacgcaagtttcaaatgaactccctgaaagcattatggacagtatacgagaagtccgcgattattttgaagagtctaccattcttcagggaatcgatgtgatctatgatcggcagtttttgacagagcagcgacggcttgccgataagctaggatatcaagaattgctgaaagaagtcattgcttttattgacttgaccaatatcacaacgatggctcgaggaatattgcagaaaagaacatatgggttcatgacgacggtgctttccagttcgggaagtatcgaaaaagaagtatttttgaactttgtagataaagatatggaagcttacacgaactttctattagagacagattatgctgagtttctgcgccctgtcatccgtgagggaaatcttgatctcgtaaagcttgaacagttgaaagatgattatctaagttcattgtatcaagaagcacaaacccaggctttcggaccactgccactactagcctttttgaacgcaaaagaggtagaaagcaaaaaccttcgtttactggttatcggcaaaagaagccattttgaaccagaaacaatcagaaagcgggtgagacaagtctatgacgcataagatcggtgtagttggcgacaaagattctgttttgccattcaaattgtttggctttgatgttcgttatggtacaaccaagcagaccgttcgtcaggcaattgaagaaatggcaaagaatgagtatggcgtgatttatgtcacggagcaatgtgcagcactgagcccagaaacgatcgaacgttacaaagaacaaatgatacctgctatcgtattgattcccaaccatcaaggatcattagggattgggctggaagaaattcaaaaaaacgtagaaaaagcagtaggtcaaaatatcttatagtatgaaaaggagatagaaattttgcaaattggaaaaatcataaaagtctccggacctcttgtaatggctgagaacatgtctgatgccagtatccaggacatgtgtttagtgggagatctaggagttatcggagaaattatcgagatgcgtggcgatgtggcgtctattcaagtatatgaagagacctcaggaattggtccaggcgaaccggttcgttctactggtgaagctttatctgttgaattaggaccagggatcatttcacaaatgtttgacggaatccaacggccattagatacctttatggaaatcacacaaagtaatttcttaggacggggagtccaattgcctgcattggatcatgagaaaaaatggtggttcgaacccacattagaagccggagaaacggttagtgctggcgatgtgattggaatcgtagaagaaacaaaagttatcaaacacaaaatcatggtgccaaatgggataaaaggtacgatcaaaacaatcgaaaaaggatcgttcactattgatgaaaccgtatgtgtcgttgaaactgaaaatggtgacaaaaacttgacgatgctccaaaaatggccagtcagacgtagtcggccaatcaaagaaaaattaaaccctgatgcaccgatgatcaccggacagcgagtgatcgatacgttcttcccagtgacaaaggggggagcagcagctgttcctggtccatttggtgcaggaaaaacagtcgttcagcatcaaatcgcaaaatgggccgatgtggacatggtcgtttatgtgggatgcggtgaacgcggaaatgagatgacggatgttttaaatgaatttcctgaattgattgaccctaatacaggagaatcattgatggaacgtacggtattgattgccaatacatctaacatgccggtagcggctcgagaagcttctatctatacgggaatcacgattgcggaatatttccgtgatatgggttatgacgttgctatcatggcagactccacttcgcgatgggcagaagcacttcgtgagatgagcggacgtttggaagaaatgcctggtgatgaaggttatccagcttatcttggttcccgtcttgcggaatactatgaacgatctggaagagtcattgctttaggatcagaaggtcgcgaaggaagtataaccgcaatcagtgctgtatcgccttctggaggagatatttcggaaccagtcacacaaaatacattgcgggtcgtaaaagtattctggggacttgattcgactttagcccaaaaaagacattttccttcgatcgattggatccaaagttattctctttattcaacagaagtagggaagtacatggatcatatccttcaagctgactgggcatccatggtcactgagggcatgcgtattttgcaggaagaacagcagctgaatgaaatcgtgcgtttggtagggattgattccctttcagataatgatcgtctgacattagaagtggcaaaatccattcgtgaagattatttgcagcaaaatgcttttgatgatgtcgatacattcacttcaagagagaaacaattcaaaatgttgaagatgatcttgacctttggtgaagaaggacgccgtgcgttgtcgttaggtgcttatttaagtgagatcatggacggtaccgtatcgattcgtgaaagaatcggacgaagcaaatatatcccggaaacagaattagaaaaactagatcaaattatcggtgaaatcaagcaaacgatgcaaacaatcgtttcagaaggaggcatgagcaatgattaaagaatatcgtacgatcggtgaagtcgtcggtccattgatggcggttgaaaaagttgctggtgtcaaatatgaagaattaatcgaagtccgtatgcaaaatggggagattcgtcgtggacaagtattggaagtccaagaagataaagcaatggtccaaatatttgaaggaacaagtggtatcaatttacgtgactcttctgtacgatttttaggacatcctttagaactaggtgtatcggaagacatgatcggtcgagtattcgatggcttgggacgtccaaaagataatggaccagaaatcctgcctgaaaagcatttggatattaacggagaagtaatcaatccagtagctcgggattacccagatgagtttatccaaacaggtatctctgcaatcgatcatttgaacacattagttcgtggacaaaaattaccagtattttctggttctggtcttcctcacaaagaattagctgctcagatcgcgcgacaagcaacggtacttgattcatcagatgatttcgccgtagtctttgctgctattgggatcacttttgaagaagcagaatttttcatggaagattttcgacaaactggtgcaatcgaccgttctgtcatgttcatgaatttagcaaacgaccctgcaatcgaacgtattgctactcctcgtatggctttgactgctgcagaatatcttgcttatgaaaaaggaatgcatgtattggttatcatgacagacatgaccaactatgcagaggcattgcgagagatttctgcagcacggcgagaagttccaggaagaagaggctatcctgggtatctttacacgaacttagctactttgttcgaacgagcaggaaggatccgcggactaaaaggatcagttactcaaattccgattttaacaatgccagaagacgataagactcatccgatccctgacttgactggttatattacagaaggccagatcatcttgactagagagctttacaagagtgggatacaaccaccaattgatgtacttccgtctctttcgcggttaaaagataaaggaactggacccggaaagacaagagaagaccatgcggctacgatgaatcagctttttgcagcctatgcacaaggaaaacaggcaaaagaattagccgtagttttaggagaatctgctttatctgatgtagacaagatttatgcgaagtttgctgagcggtttgaaaaagaatatgtcaatcaaggattctacacgaaccgttcgattactgaaacacttgatctagggtgggaactgctatcgatgttgccaagaaccgaattaaaacgaatcaaagacgacatgctggacaaatatctgccagaagggaagtgagttctgatggcacgattgaatgtgaatccgacccgcatggaattgacccgattgaaaaaacagttgacaactgccacaagagggcataaattattaaaagataagcaagatgaactgatgcgtcaattcattctgttgattcgaaagaacaaccaactgcgtcaagaaatggaagagtccatgacagaagcaatgtctgattttgtattggcaaatgcttcaatcacggaacctttcatcgaagaattgtttgctttgccggcggaaaacgttgatttatctatcgtagacaaaaatatcatgagtgtaaaagtacctgtgatgaattttgaatatgatgaacagctgacagacacccctttggaatacgggtatttgaattccagtgccgaactggatcggtcaatcgatcggtttactaccttgcttccaaaacttttggaactgacagaaatcgaaaaaacttgtcagctaatggcaagtgagatcgaaaagacacgtcggcgagtcaatgcattagaatatatgacgatccctcaattagaagaaacaatctattatattcgtatgaagctagaagaaaacgagcgcgcagaagtaacaaggttgatcaaagtaaaaaatatgggtaccactgactaagtggtatccttttttaaaagaggaaaacgatgattaaacaaaacaaacaaataaagaaacgcttgccggccgttcagcttctcgcattaggattttttctcctgattttagttggcggtggtctacttaccctgccattttttagtaatagtgggcatgggacaaattttatcgatgcgcttttcactgcaacttctgccgtctgcgtgacgggattgacgacattgaatacagcagaacattggaacagtgctggtcagtttttgatcatgcttttgattgagattggcggtcttggttttatgatggttccgattctatgctttgcattgataaagaaaaaagtcagtctcagcacacgtatcatattaaaagaagcgctaaatctagaagaagtatcaggtgtgatgaagctcatgctttacatcctgaaattggcctttgtgatccaattgattggtacggttgctttatcttttgtattcgtgcctgaatttggctggttgaaagggatctggtacagtttgttccacgcaatctctagtttttgtaatgcagggtttgatttgttaggagacagtttagccaatcaccagcaaaatgtctatttgatcatggtggtatcagctttgatcatttctggcggattaggctttatcgtttggcgtgacttattggaatatcatcagaaaaagaagatgacgattcattcaaaaatcgcattaaccgttacaggtacccttttattaggcggtttcgttgtgttctttttcacagaacacaatggggcaacactagtggaagggaatatgtttcaacgattggcaaatactttttttatgagtgtaacacctagaacggctggatattattcagttgattacctccatatgagtcatgccggtctgatcttaacgatgtttttgatgtacattggcggaacatctgggtcgactgccggcggattgaaaacaactacgttaggtgtgttgctgatccagatgcgttcgatgttgaaaggacgtacgagagcggaagcatttggccgtacaatccgtcaaggcgcagtgttgcgagcactcacgttgttttttatcacgttgacactgtgtgtagtcgccatcatgattttatcagtgactgaaacgatacctaaaacttctggcatcgaatatattgcttttgaggtcttctctgcatttggaacagtaggacttacgatgggattgacgccagatttgactgcaatagggaaattgatcattatagcgcttatgtacattggacgagttggggtattgactgtggtcttctctctgatgacaaaagcacaaagaactcaatcaaaatacaaatatccagaagaaagtgtcatgattggataatttcatcttctgacagaaatctagtgatctagcaaaataagaaaataaaatataagacaaatttttttgctgtttggttactttaagtgcaaaatgttcatttgctttttgaggcactatccgttgttgaacttcgggtagtgcctcttttttatcgaaaggaatcaatcagctatgattcctttatttatcaatagattataattcatatttttttattttttcttttacgatacttagtccagaagctaaaatctcaaggttgtttgaagatagggaaatacgaacgaatgcatccggttgtgctcgcgtagtaaagcgtcgggaatgatagagtcggatgccgttagacagaaagtcattctcaatccgcttaggatcaatctcaggatcaactggaagaattcgataataaggaacacgattcgttggtttttctactttgaaaagagaatcaaaaagctgattagctcttttcgtaagatttaatttagtttctaagattctatttgcttcatttgaatggaggatttgagtgatgacctccacatctaatccagaagttttcacatttatattaaaaattgcttgttctatcttgctttggacatgtactggagctacaagataagcaactcgcaatccagaacaaataaattttgtcattccagctaagtagattgtttggttaggtaacaatttttggaaaggaggaatgatcgtatgttgataataagttgttaaaaaagaatggatatcatcttcgataacccatagaccttctttttcaattacttcggctaattgctctcgtctttggtgagagatttgaaaccctataggattattgcaagaaggcataagaaagacaccatggatcttcttttttctacattcctgaatcaatatatcaggtcgcattccttgctcgtcaaaatcaattggaacgatctctaaatgatataattgagccaattcaatgaaattagcgtacgtatatcggtctgttgctattctatcacctggagagaaaagtgcagaaagtgtgatagccaatccattttgaacaccggaaacaatagacagagattctaaagacggaatgactccttgagtttttaaccaatttgctgcagtagtcaattgaaaatttgtgcctttgggatcttggtaattaagcaaaccaacaagatttggattattaccagttgattgaataaacgggacaacgaatttattacattcttcaaaagaactaaccagaccaaaatcaatgatatgttcggttacttcattggtagagatggtaatggattcaaagacattgggagaaataaaagtgccacttccaatattcgtatacagcaaacctttctcaattccgtatttataagccttgccaacggtagtaaaatttaaatctaaataatcagctagctctctttgggagggtaactgagtgtttttctgtaatttattctttaaaatatcttgttctaattgttgaatcaacgatcgataataaggacgcttcaatttttgtttgtctggccgccaagttaacgggtagttgtcataagaattaataggcattttctccactccttaaaattgtataccatacaattttaccattgattgtattgattttagaagttaatcttttgtgaggagggaattgtctatgaaaattattaattttgaggaagtagtagcttcttttagttttgaagaagcgatccaagtaatgaaaaaatgtttctttgattatgaaagtggtaaaatcagccaaaatcctcgattggtggaaattttaccggacggaaaagacaaaaatgtgtttgcgatgatgcctgcctatttgggagagaatagatattttggaacaaaagtcattaccgctttcccggataatcatcagtatcatttaccttctcatttaggagagattttcttgtttgatgctcaaaacggactacccagagcattgataaacgcaaatgcagtcacttggattcgaacagctgctgtatctgcgctagcaacagattacttagcagatcagcatgcagaaacacttgctttaattggagctggtcaacaagcattgtcgcatttggctgcgatttctaccattcgtcgcatcactacagtgtttgtttacgatattttagaagaaagacgaaatgcttttatcgctaatgctaaaaatcagtatcctaaaatgacgtttataaatgcaatatcagtagaagatgcagtacgctcagcggaaatcatttgtacgttgacccctagtaaagaggcatttcttcaaaaagagtgggtaagggaagacgcacatatcaatgctgtgggcacgtttactcctgatacaagagagataagtacaccattgatggaaacttctcaaatctatgtagatgattactcagctgccttaacagaaagcggagacctacttatagccatgtcagaaggagatctagaggaatcttgtattgttggtacattaggcgaattagtttctgggaaaaaaacattttacaaaggagaatcgagtccgacgattttcgacgcagttggtctagctgttgaagatctttgctgtgcagaatatatttataacaaattagagagaggatctttaaaatgaacttagattattacgtagttgatgcatttgcagatgaggtgttcaaaggaaatccagcagcagtgtatgttctagaagaatggctgccagaaggtacgatgcaaaaaattgccattgaaaacaatttatctgaaacagcatttacagtgaagaaaaatcaaggatttgagcttagatggtttacgccagatcgagaaatcgatctttgcggtcacgcgacattagcaacagcatttgttttatttaactattacaaaatacttgatgaaacgattaaattttctactcaaagcggtaatctaattgtgacaagaattgaagattattattgcatggattttcctagtattatgccaaaaaaagtaccaatattgtctgaatatgaagaagcgataggggctaagattaaagaagcctacttagcacgtgatttatttttcgtattagaagatgaaaaagcggtggctaaattgcagccagatttcacaagtatcaaaaattttgatttaggaataggggtcatcgtgacagcagaaagtgtacaagaagactttgtttctagaaccttctttccaaaattaacaatcaatgaagatccagtatgtggatcagcacattctaatcttattccttattgggcaaaaagaatgagtaaaacaaaattgtcagcttaccaaatgtcatcaaggggcgggtatctagagtgtgaattaaaagaagatcgtgtgataataggaggaaaagcagttttgttttctaagggaacctcgtttatttgatttctttcaaatgaactaaaaataaataagtgtagagtggcagccttatagctacaatagttgttaaaaaaagacgcaaactttttcaatttaaagaaagtttgcgtctcattttaattattggcgtttgttttttgttcaatcaagagcaaaatgccccctactaactagcctcggatgacttcgattttataaccatcagggtcaatgacaaagtagtaagaaggcgcagtgccaggtaatccttttaagtcagtaatttcaagacctgcagctttatgctgttcatgtaatttttctaaatcatcagctgcaatagcgatatgaccataaccatttcctaaatcataggaaccatgatcgtagttataagtcaactccaattcatagtcatccccaggaagtgtcaaataaacaagtgtaaatttgttttctggaaaatcacggcggcggctttcttcaaaaccaaatgccttttgataaaattcgattgatgcttcaagatctttcactcgaacacatgtgtgagccattttcatagattcatctctccctttccttttatttaatcataacaaaaagaagtaaggaaatagttgatttgtgcttgttcatgagaaatttctcatgtaaaatggatagaaaataaaactgttaaggtggaaactattcatggataaaccaatttttggtgaaaaaaagcaatttgctgattatcaaacccgttatgcagcatatattgtcatagaaagagatcagcagattgcagtaatcgaggctccaaatggtgctttttttcttcctggcggggaaattgaaggagatgagacgaaagaagaagcaatcgttcgtgagctagtagaagaaatggggattgcggcagaaatcgctttctatctgggagaagcagatgagtacttttactcgaattatcgtgcaacttattactataatccaggatatttctttgctgctgattcttggaagcgtataggagaacccacagaaaagaccaataaaatctggtgggtcagtcctcgagaagcacttgaaaaattgaaacgtggcagccatcgatgggcagtcgagagatgggtcgaaaaaaataaaaaataaaaactgaaagaaagcgagtagaccagctttctctcagtttttttattacagaacgtattttttgattgcttcagctacgccgtgttcgtcgttcgatgaagtgatgacatttgctgcttctttgacaagagaaacggcatttcccatagctactcctagaccagcatattcaatcatggataagtcgttctcgttatctccgatagccatgatttcatcttgatcaataccaagatgctgtccgagattcgcaactgccgcacctttacttgcttctttatttagtacttcaaagtaatagggtgcacttttgaccgttgtgtatttatcacggaaagtttgtggtaaacgtgcaattgctgcgtctaaaatttctggttcgtcgatcatcatcattttgacgatgttcatgtctggtgtcatttcttcaggtgttcgatattttagcggcatcttgactaagcttgcttcgtggatcgtataagcgctgatatcttgattaggtgtgtagatcgctttgtcatcaatcgaatggagatgactgccaacacggcgtgccatcacttcgatctctagaaaatcttcatgagtcagaccgtgacgggcaatgattttacctgattttgtttgttgtacgagtgccccattataagtaataacgtaatcattatcttgaaaaaggtccagctcgtttaactgttcttggacacctggtaaggggcgaccagtacataaaacgattgagaccccttttgcaacagcagcggcaatcgcttcttttacttcttttgttacttctcttttctcatttaataaagtaccatcgatgtcgatagcgactagtttgatagccataatttcctccaatatatttcagtttatttcaatcaatgcgccattacggatatggctggcaaattcttgataagtttcatcaaataaatcataatgatcacgcaaggatgggtcaaccatttcttttggaaagaaaaatcgctcatctccttgttcttgtcccgctaaagcggcaacaagctgactaacctgtgataattctatcaaagttccgtcatttcgcaaaatctcgatttgcgtacgatgtctgccttgttctgggcgataaaaatcataaggcagatcgtagctagagttgacagcagtgtaataaacagggttatagccaaccttttctactaacaaagtgagtttttgaatcaaatttgaatctcggttgccagaaaaagtggcggatttcagtggtttacgattcaaaaaacgtttagctaaatcatttaaaataggatcagcagattcagaccattgagtaaagtaagtacccaagaccccatcatcaagtttgagatattcttctaaagtaaagcttccgtcaagaaatggcaagagtagttgagagtgaagttcaaaactgctggcatcttcttgatacaactcgtgcgcgcgatgaagcagatgctccaagatcacttccataccacgggaaacaggatggaagtacacttgcacatacatttgatatcggctaacgatataatcttccactgcatgcatgccgctcatagaaaaggcgatcccaccttcatatggacgaatcacacgtaatattcgggtaaggtcaaatgttccatactccgttccagtgaaataagcatcccgaagcaaatagtccattcgatctgcatcgatctggctggaaatcatttggacaacttgcggattagggtaggttttttggatcacgctcgctactttttcaggaaaaccttcttctactcggttaaggatctgatacacctctgtttctggagaagtgataatctctacagtgatagcctcgtgattcgtatggaagatatgctcgaatgtatgagagtaaggaccgtgaccgacatcatgcaatagtgccgcacataaagttactagccgttcctgatcatcccagcctccgttgcctatcttttcttttggaaaatttcgagaaaagatatcgcaaattcgtcttgaaatctcataaacacctaatgaatgggtaaaacggctatgttctgctccgtgaaaagtgaaagaagcagtgcctaattgtttgattcgtcgcagacgttggacttctttcgagttgatcaaatctaagattacttgatgctggacatggatatagttatggactgggtcacgaaaaactttctccataggcagcatttgatatttataaggggttgtcatattgtagctcctttatgttattgcgttgttccattctctggatttggttgttccattgctccagctggatttctttttttagccagtcggtagaatccagtaaatcacttgcagaatacagcttttcaaaagcttttgcaaatgattctttgacttcttctacgagaaggggatggtcaagcagttcttcaagtgttgccattgtggcaggatcaactgcaggatagccatttgtaccaaagccttcttttaaagcagattgataaaatcgtttcatgacttgcccacgcttttcctgattaccgttgacacttaagtacatcataacagaaatcccatttttgatgcgacgctgagcgatgccggcaaattttttgccatggatgcttaaatcataagttccaggacaataagaatgggtgatttcgaatgcttgaatcggtgccttcggaaaggcgtatttagtcaatcgaagcatttgctcgtaagcttcatcgatggttattttttttttgtcattctgggggaaaatcaaagaaatattcaaaatcccttcgtctgatacgattcctaatccacctgagtttctgattaccggagcataacctgcatctttcagtgtttggatcccgtctctaagaaaaggtgtccgaacatctttcatacctaagatgacggtgcagtcatattgccagaaatgcaaaaagatctgctggtgttctttggaatatttcgttaatatatctgttaatgcgaaaggggaaaagtcgtttttttgataaatgtgctgatctagtcgaatcgcagggttcattcaaccggctcctttttataaattcatattttctacaatattatactctaaattcaaagagttgttttgaaaaaaaggttttctgtaaaaatggacaagttggttgacaaaacaaaagaaactaggaacaatgtagctatgagaagtaaaggagaatgaagaatggaattatcacaaggaacaccgatttcgatcaaattgcgtacaaaagtgaaacaacaaggggaagtgcaagatttttattttgatttgaaagggcaaatggtgacgattggcgatacgctgtacatacggtataaagagatgcaggaggaaacaggcgatgaaatccctgtaacgatcaaattagttccagatggtcatgtacagctgatccgtgcaggagaaatgcgaatgcgtttgaaatttggttataaagaacggttagaaacagcctaccgaacaccatacggtatgatccagattgctacctttacgaaagaactgcatgtaagtttgaaagaccgtcccacagcaggaaaggttcggatcgattatgatttgttcatgggactagaaaaaatcggcgaatattatttgacattggattttacagcgtaaatataaaagaaaagtttgattttttgtgtctgattttgtatgataaggagtagactgtgaaaggacgtgtcctgattggaaattagtatatttgaaggtgcaaacaaaagcgaattatcaatgatcgaagtagcacacgcgatcttagaacaacgtggcgatgtcatggatttttctgatttagccaaccaaatccaaaactatcttggcaaatcagacagtgaaattcgtgattcactcgcacaattttatactgacttgaatattgacggcagctttatctcattaggggataatcgttggggtttgcgttcatggtatgctatcgattcgatcgatgaagaagtaaaccatggaatggacgaagaggatgaagatactccgcgtcgccgtaaacgcaagaaagtcaacgcctttatcaatgatgatgaagacgcgatcgattacaatgacgatgacccagaagatacagatctgacagaagaagacgacgatgatctgtttgatgacgatgatgatgaagatgaagaaatcgctgcttataattctgacttgcaagaaattggagcagatgacccaacagatgatgaagaagacttgcctgggaatatcgaagaagatttaagtatcatagacgaagacgatgatgatgaagactatgaagaggaagaattttctgactctgaaaaagaataaacatcatttactgtagaggctgtgacggaagtggtcaacttcaagaaatttccacttatttccgaagaagctacttctagaacaccgtgtatcagaggttgcaacagagacgttgaagctatcagaataagaaggtgtgacatgatttttgtcacaccttcttttttgtatataaaaattcaaagtaaatacataaaaaataaaataattgaaacttttagcgtaccttgtacgtcatattaagtgaggcggaaaggagtggagaatgatttttactggatataagaaaaaacggcagattgaaaaataccgtcacctgctgaatggactcatcgaaactgattatcaaaaaatgttccgtatcacgatgaattacgtacatgataaagaagaggccttagatgtgatgcaagatagtttccataaagcactgaagtattttgaaaaagaaaaagaaatcgagcattttagtgcatggttttatcggatattgatccgcacggcattagatagttggcgcagacaaaaaaggacacctgttgacttatttgaaattcaagatatcccgcagcaattacctttagaaacttccgttgcagaactccatatgattttagataaaatagacagtccggaaaaagagattctgatcctttacttttttgaaggatttcgtttgaaagaaattgcgactatcttagatatgaacgaaaacacagttaaaacaaaaatgtatcgttcactgaatgttttacgtcaaatcctagaatgaaggagagaagaccgctatgtattcccaaaaagaaaagttaaaaaaactaaagaaaacttataaagaacaagaaattccaagagggcttcaagaggagatccgccagcgttttcttatcgaagagcaatcattcataaaagcaagacggagaaagagacgcctccaagggttcggagtatctttggctatcgtgatgattacaacaagtagtctcctttttaatagtcaagttcgaagctttgcagaagacttgcccattttaggatcagtcattgaattgatcttaggcgaacgttttactgatcaatctgaaaaaatcgatattcaagtaccgaagatccatactcaaaatgagaaagaaaataaaacgattcatggattaaaccaaaaatactttcacgaaggacaagcagattttaaaaaagctgaaaaagaatacggaaatcttgaaacggatcattaccaagttctgggtgattatcagaaaatcgtagacgatgaccggtttcttgtgatcgaaagacagattacccaaacagcagcggatagccacgttgaaaaaagatacgacacgatcgacaagaaaaacagtgtccagctctcacttccgctgttattcaaagatgacacctatttatctgttttgacaaaagaagtcaagcggcaaatggccgaacaagtcaaggaagatccgtctaagtactattggactgaacaagatattcaagaaggaacgatagaaaaaccaacacttgttacaccaacacgaagtttttatttgaataaagaacatcaattagttctgactttttctcaatatgaaattgctcctggttatatgggaacaccagaatttgtcattcccaagtccgtgacaaaaacgattttggcatcggaagattatctggatcattaggcgagaagtagttgcgactagcagtttcaattctttacagttattttcaagtaagtaattaagaagagaaaaagagaaagaagagatatagtgaaaagaaattatttagttatcagtatcattgctttatccgtgcttttatttttcgaagtcacttcggttgcctccttgatcagcgaagagaaaggacaagtaacttcttcggagcgttcgtcacaagctttcaaacaatcagaacaatcaacgaataaaaacaagtcgactgaaacagctagcgtcaacgaatccactcaagaatcagtgaaatcaacacaaagtcaatcaactgaaccagaaccaacacaagaaagtacagaagctgtccaagatccgactgtcaaaagtattgccatcagttttgatgatggaccaggagcgactacgacaccacagcttttgcaaatacttaaagtaaaaaacgtgcatgctactttttttgttttaggagaaaatacggcgcaacatcctgaaattgtgaagcagacagctgaagcaggacacgagatcggcaatcacacgtatgatcatcaggatctggcgacgctttctgcccagtcgattacggaggaagtgacaaaaacagacactgagatcaaaaaagccactggcaaaacctccgctttcgttcgtccgccctatggttcgatcacaagtgtaggagcaagtgttatccagcggccaatcatcgaatggtcggtcgattcagaagattggaagacaagaaatcctgatttgattttacagaagatccaagcaacagtatacgatggtgcaattactttattccatgatatttatcctgaaacgattcgtgccgttcctcaagtgatcgattatctgcaagagcaagggtaccgcattacgacagtgggggatttattaggacatccaacgactgtcgagaactattatggcagaaacgatcatcggccagtccagtaagtgaaaacaagtatacttataataaaaaactgtccgccaatttttttggtggacagttttcacttgaaaaataaagaagcaaacattcggaagttatgctaaaatggcaatagaacgcgtcctgagggaatcgaacccccgtctcaagaaccggaatcttacgtgatatccactacactaaggacgcaagcactgggataattgtaactaaacagataaaaaattacaaggggattggacaaaaaaatgaaatttgagcaaaatttttcacaaaaacagcagcagacacagaaactagccatgacgcaacagttgcagcagtccatccaagttttacaatataacagtgaagagctgttggcattcgttgagaaccaagcaatggaaaatccattggtggaagttgttgagccggaatggcagccagattacataaaagcttcttcatcttcttatgaaggagaagagacaaattacctaaatcagattcctgatacaaaagggtctttatttgattcattgatcgaacaagtccatttgaattatcgagatacttttttaaggaaaatcgttctttatcttgtagaatacatcgatttgaacggatttttgacgattagtttagaggaagctggaaaagagatcggagcgacgcctattcaaatgctcgatgcattgacactgatccagcaattagaaccagctggagtaggtgcacgtagtttgcaagaatgtctcatgcttcaaacggaacgggatgattatgcgccggaactagcttatattgtgctagaagaatgttttgagcaattggtggagcgaaaatggaaagagattgcgcagcgtttttctgttgatttacatgctgttcagcaaatattcgactatttgcaaacattgagcccaagtcctggacgaattttcgaccgtagtagcgaattgtacattattcctgatgtccgggtattagtggacgatgaaaatgtacaagtcatctcaaaccgaaaaaatcagccgaatatccgattccaagagacctacttcaagcaaatgtcacaacaagcagataaagaaactgaaaattatttaaaagaacggaaacaggaattcgaatggttgaagaaaacgatcctccaacgcggggatacaattttgcgggttgctcaagtcattgtttctcgacaaaaagctttctttatcgacaaggggcggccaatcaaacctcttacgttaaaggaagttgcggctgagatagatgtgcatgaatctacggtcagtcgagctgtcaacgggaaatatttggaaacagatttcggtgtatttgagttaaagaaatttttcactgcaagaatccctactaacggtgcagaacagacagaagacctttcggcagatactgcgaagaaaaagttgcaggaattagttgatcaagaagacaaaagcaagccgttgtcggaccagaaattggttgaattgctgaaaaaagatgagatagcgatctcaaggcgaacggtagcaaaataccgtgatttattaggaatcccaagttcatcaaaaagaaaacgttatgataactgatcatccaaaagatcagaaaaagtattttgctttttctgatctttttagttgaaaaacgaaagaaaaactgttagactaacagtcgtgaggttgagatttccctttattgatgtgaaatttgaaaagttaatttcttttttttatcgtatatgggtcgttttaagtctacattggacgtaaagtgtccaactaaggagatcgctatgctagatgaaataaaaatgattgaatctgttgcaccagatattatcgaagtgttgcaagaacgctataaaattttacgaaatatctattggatgcaaccgattggacgtcgaagtttatcggaaagtatggggataacagaacgagtattgcgaacagaaacagaccttttgaaaaatctgaatttgatcgatacctcaaaaagcggtatgacgctgacaactaagggcgaagaagtttatcaaagtcttgaaaacttcatggatcagcttttaggtacgcatcaaaccgaacaacagttggcagaatattttggtaatcagcgctgtatcgttgtttcaggaaacagcgaagagcaaaccaaagtggctgatgcattcggcgaagcgctgagtgaagccttagaccgactgcttccggaaggcgagaatatcatcgctgtgatgggaggaaccaccatggcagttgtagcagaacaattgtctaatctggaaaataaaaaacggcataacttgtttgtccctgcaagaggcgggattggtgaagcgataactgtacaggcaaattctgtcagtgcaagaatggctgctaaagcaaatggaaaccaccgtgcactttatgttccggaacaattaagtctggcaacttacaattctttactcaatgagccatctatccaagaagtcttaaacttgattagtgaggcgaattgtgttattcatagtattgggcgtgcattacacatggcagcacgtcgaaagatgactgaaaaagaattagtcatgctgaaacaagcaaatgctgtagcggaatcctttggctactttttcaatgaaaaaggcgaagttgtttataaggtccctagaatcggcatagaattgcaagatttggcgaaagtcccgatcatcatggcgatagcgggcggaaaatcaaaagccaaagcaattcgagcttatatgaaaaatgcaccaaaacaaacgtggctcatcactgatgaagctgctgcaaacgagattttaaaaggggtaaccctttaaaataaatatttttttgattttcataaggaggaaatcttaaatgacagttaaagtaggtattaatggttttggacgtattggacgtctagcattccgtcgtatccaagatgtagatggaatcgaagtagtagcaatcaacgacttgacagatgctaaaatgttggcacacttgttaaaatacgacacaactcaaggacgtttcaacggaacagttgaagttcatgaaggttcattcaacgtaaacggaaaagaagttaaagtattagctaaccgcaacccagaagaattaccatggggcgaactaggcgtagatatcgttctagaatgtactggtttcttcacttctaaatcagcagctgaaaaacatttaacagctggtgctaaacgcgttgttatctctgctcctggcggaaacgatgttccaacaatcgtttataacacaaaccacgaaacattaactggtaaagaaacagttatctcaggtgcttcatgtacaactaactgtttagctcctatggctaaaacattgaacgacaaatttggtgttgttgaaggattaatgacaactatccatgcttacacaggtgaccaaatgactctagacggacctcatcctaaaggtgacttccgccgtgcacgcgctgctgctgcaaacatcgttcctaactcaacaggtgctgctaaagctatcggtttagtaatccctgaattgaacggtaaattagacggagctgctcaacgtgttcctgtaccaacaggttcattaacagaattagtaacagttcttgaaaaagaagtaactgttgacgaaatcaacgcagcaatgaaagaagcttcaaacgaatcttacggatacaacacagacgaaatcgtttcttcagatatcgttggtatgacttacggttcattatttgatgctacacaaactaaagtaatgacagttggcgacaaacaattagttaaaactgttgcttggtacgacaacgaaatgtcatacactgcacaattagtacgtactttagaatacttcgctaacttataagatagacaaacgtacaagtgtaaatgatagacatgtacatttaaaagcggggaagcaatcgcgcttcttccgctttttttgataataagtttattcaggaggaaataaaatggctaagaaaacagtgaaagatatcgatttaaaagacaaaaaagttcttgtccgtgttgacttcaatgttcctttgaaagacggcgtgatcactgacgacactcgtatcaaagcagcattgccaacaatcaactacgttttagaacaaggcggaaaagcaatccttttctctcaccttggacgtgtaaaaacagaagaagataaagaaggaaaatctttagctccagttgcaaaacgtctaggcgaattattaggtaaagaagtaacattcgtacctgaaactcgcggagaacaattagaagaagcaatccgcaacatgaaagatggcgacgttgtcgtatttgaaaacacacgttttgaagacgttgacggtaaaaaagaaagcaaaaacgatacagagctaggtaaatactgggcttcattaggtgatgtatttgttaacgatgctttcggtacagctcaccgtgcgcatgcttctaacgtaggtatcgcttcaactggtatcccaacagttgctggattcttgatggaaaaagaaatcaagttcatcggtgaagcagtagaagaaccaaaacgcccaatgatcgcaatccttggtggcgcaaaagtttctgataaaatcggcgtaatcgaaaacttgattcctaaagcagacaaaatcttgattggtggcggaatgacttacacattctacgaagcaaaaggaatcaagatcggtaactctctagtagaagctgacaaagtagaactagcaaaagaattgatcgaaaaagcaggcgacaaacttgtcttgccaatcgacaatgtctgtgcaccagaattttcaaatgatgtagaaacacaagtaatcgaaggagacattcctgacggtttgatggctttagacatcggcccagcatcagtaaaattatttgctgatacattacaaggtgcaaaaacagttgtttggaacggacctatgggtgtatttgaaatgagtaactttgctaaaggtacaatcggtgtttgtgaagcaatcgctaacttagaaggcgcaacaacaatcatcggtggcggagactcagctgcagcagcagaacaattaggttttgctgacaaattcacacacatctcaacaggtggcggcgcaagcttggaattgcttgaaggtaaagaattaccaggactagcagcaatcaacgataaataaacagccaagtttgctctattctgacgagtgatcgatcaaaaggtgaagggagttttcatgactccctagccatttttcaataaattaaggagtgtgttcctcaatgcgtaaacctattatcgcaggtaactggaaaatgaacaaaactgcatcagaagcaaaagaatttgctgaagcagtaaaaaacaaaatcccttcaaatgacaaggttgattcagtcatcggatctcctgcattattcttacaagaattaatgacatcagctgaaggtacagaactaaaaatctcagcacaaaactgctactgggaaaactcaggcgcgttcactggtgaaacttcaccagcagctcttgctgatctaggtgttcactatgtgatcatcggacattcagaacgtcgtgaatatttccatgaaacagacgaagacatcaataaaaaagcaaaagctatctttgcaaacggtatgacaccaatcttatgctgtggcgaatctttagaaacatatgaagcaggcaaaactgctgaatggatcgaaggacaaattacagctggtttagctgacctttcagctgaacaagtgtcaaacatggtgattgcttatgaaccaatctgggcaatcggtactggtaaatcagctgacgcacaaatcgctgacgaaatttgtggtgttgtacgtcaaacagttgaaaaactttatggaaaagaagtatcagaagctgttcgtatccaatacggcggttctgtaaaaccagaaaatattgctgaatacatggcaaaagaaaatgttgacggtgctttagtcggcggcgcaagcttgcaagcagattcattcttgtcattgttagacgctgtaaaataattggtgaaaatttgcgaaaaatgcaagaaatgtttgcactaatgagcaaaattaactaaaatcgtatatgagggaaatcccttaggaaaaaacaaactcaaaggagagacaaaacatgtcaattattactgatgtttacgctcgcgagatcttagactcacgtggtaacccaacaatcgaagtagaagtatacacagaaagcggagcttttggccgcggaatggttccttcaggtgcttcaactggtgaatacgaagcagttgaattacgtgacggagacaaagctcgttatggcggtaaaggtgtaactaaagctgtcgacaacgtaaacaacatcattgctgaagcaatcattggctacgatgttcgtgaccaaatggctatcgacaaagctatgatcgctttagacggaactcctaacaaaggtaaattaggtgcgaacgctattttaggtgtttctatcgctgttgcacgtgcagctgctgactacctagaagtacctttataccactacctaggcggattcaacacgaaagtattgccaacaccaatgatgaacatcatcaacggcggatcacatgctgataactcaatcgacttccaagaattcatgatcatgcctgttggcgctccaacattcaaagaagctctacgtatgggtgctgaagtattccacgcattagcttcaatcttgaaagctcgcggattagcaacttctgttggtgacgaaggtggatttgctccaaaccttggttcaaatgaagaaggtttcgaagtaatcatcgaagcaatcgaaaaagctggctatgtacctggtaaagacgttgttcttgctatggatgctgcttcttcagaattctacgacaaagaaaaaggcgtttacgtactagctgactcaggcgaaggcgaaaaaacaactgacgaaatgatcaaattctacgaagaattagtttctaaatatccaatcatctcaatcgaagacggattagacgaaaacgactgggacggattcaagaaattaactgacgtattaggcgacaaagttcaattagttggtgacgacttgttcgtaacaaacactcaaaaattatctgaaggtatcgaaaaaggaattgctaactcaatccttatcaaagtgaaccaaatcggtacattaacagaaactttcgaagctatcgaaatggctaaagaagctggctacacagcagttgtatctcaccgttctggtgaaacagaagattcaacaatctctgatatcgctgttgcaacaaacgctggtcaaatcaaaacaggttctctatcacgtactgaccgtattgctaaatacaatcaattactacgtatcgaagaccaacttggtgaagttgcagaatacaaaggtttgaaatctttctacaacttgaaaaacaaataattcttttctaatgaagatacatgatcgaccgattgaaagatagacgagcatgatcacttagttaagtaatcagactctctacctgctgatttcagcaagtagagagtttttttgttgtgaaaatcatttgatgaataaatctcttttttaagaacagaaaaatcaggagagtacataaattattataataacaactgtttatttatatatatcatataaaccctattatataaatatccgtatttattaaaaataacttataattttatttttgtaactggcttctgtatataatatttacaaatatcgatacgagacaatcgtatcgaaaaaagtcagttatcaagagataacatcgtataggaccttttaaggatagaacaataagagaggaggaagcagtcttcgtttcattcatatccttttacgctcggataggatgattctcttcaaaaaggggatggcaatcttcctctttcgataaaaatcatttgaacagggagacagaaaaatgaaaaaattttagataattacaatgataaaaattataaatatgggataactacaaatatttttgagatggatccgacttactgttctaaaatcgtctggcaagcttattggtatgcttcggctgctgtgcaggtaggaggaatgtatcagccgcttattgctttgccatacgatcttcctgattattttgatgaaagagcgatccatatcttaacatgggagaattgatgatgagaaggaggatttctaaaaaaagaaattactgttctaagatttttattcgataggtttactgttagggggtacatggctctatcaatttccaatcaagaaacatatagctacacgagcactgtatcaattattagaggaggaataccaattaaccgattatgatatttttatttcaagagtagtgaaagatacgaaaagtggtagaggcggtgtcagtatttttttcatggtaaggaatagtttgtatgaatatgagtatgactactctcttgaagaaaataattggctacgtggttattacgtaaggaggggtaattatagatcatgcgatactcttattttcaatgatgaggaataaaatgatttgactacagaagaacagttcaacaaagtagcttctcttgtttttttacttggttggatttactagcgtagaggcaagaattggaaagccatttacttggaaaaggggaatgtgacgctgcttttgtcacgcccttttttctgtggtctctcttatttgaaaatctaggcgtactccaatacaataaaaagaaacggcaaaggagaagattagatgaaaaaagaagaaaaaattgcgattttacaagagattatccgaataaaatcagtgaatggaaacgaaggcgaagtagcagcttatttgaataagcttttggaaaaacatggcataataggagaactcgtttcttacagtaatggtagagataatctgattgctcaattccaaaaagggcaatcaggaaaagtgttaggcctatctggtcatatggatgtcgtggcggcggggaatgaatcgtcttggacctatgcgccctttgcagcagaaatccatgggaatcgtttgtacggacgtggtgctacagatatgaagagtggcttggcggcaatggtgattgccatgatcgaactcaaagagtcaggaaaaccatttaacggaacagtcaaattattagccactgtcggagaagaagtgggtgaattaggtggggaacagctcacgaaagctggttatgtggatgacttagatgccttgatcatcggagagccaaccaattacagtttaatgtacacacacatgggatcaatcaactatacggtcatctcgcacggaaaagaagcgcatagctctatgccagaccaaggctataatgcgatcaatcatctaaatgaattcattacgaaagcaaatgctgaaatgaatcacctcgctgaagcaatcgagaatcccgtcttaggaaaaacaatccataatgtcacgttgatcagcggcggaaatcaagtaaacagcattccgagccacgcgcagcttcaagggaacatccgatcgattcctgaatatccaaatgataaaatcattgcattactgcaatcaatcgtcaaggaattgaatcaagagacagactaccatttggaattgacgatcgattacaacaaaatacctgtcaaagcagatccagattctcctttgattcattgcattcagcaacaattcagtcagccattacctttagttggagcggcagcaaccacagatgcagccgaatttacaaaagctgaccactccttcgactttgtcgtctttggacctggtgtcgttactttgcctcatcaaatagatgagtatgtcgagctcgataattatttagatatgatcgaaaaatatcaagctattattttatcctacttagcgtaagttttttaatagatatgatttgtcaaattaagctagaataaaatgcttcttgtacatagctcaaaaatatttttgagctatgtacaagaagcattttattctagcttaatttgacaaatcatatttcataaaaaaataatactaattttaaaaaaattcaaattcaatcaccttgttgtcaaattatcagctaggcacagtaatagcagatatgctcgcaaaatgggatatgaatgtacgcagaaactttattttctgtggctttcactattttcttaatgaactggttacatggttatatatatcatgctgaatgtttgacacgttttattgtttcgtttttataaatactttttaccttccagtttctttttagattgtattctaataaatagagaagctagtcagagccgctacctagaagaccagttattttttctcttttggtactcaatttttccatcaatcaaagaaactttccgacagtattcttcttaattcgaatagattcgcagaatagaatcaatagtagactttctgactcaatctaagattctttcatagacagtaacgttgaggcagctggttctttgtcatctacgtatgcaaaatgttataatgctagtaaataaagttggctgcctatgtactctgtctaaaacttaagaattgttgtttcctctgtcgctatccaaatttaatgaatgtctgtatattaaaactgttgtccttgtcatagataataaaggagagcttgaaaatgaaaactgcgattacgtttctattagaggaatatgccgattgggaaggggcttacattactagcacactaaaccagaatgagggatggcaaaataaaactgcttctatccaatcagaggtcacttccattggaggactaaaaacaaaaatcgattatttaatcgaacaaatacctgaaaaaattgatctctttattatgattggtggcaattcatgggacatagaaaaccaccatttatatttaataatcgataaatttttaaaaacaggcgtaccagtagctgctatttgtggggcagttgattatttagcacagagcggattattgcaaggttacaaacacaccggaaatgcgcaattaccttggttagaatcggaaaattatcataataaagaagattttatagaacaacaagctgtaaaagatcataacttgattaccgcgaatggaacagctcctatagaattcacagatttgattcttcaagcagtccattttgaaacagaagaaacaagacaaaaaacgattcgtctatacaaacttggatactatgattactataaaaagtacggagaccctttctcctaaacattctcttcaattggatactcttatcaatgttgtgacaagcaattctaacaatgattgcttgtcacacttttttatggtatttattaaagaagatacactctatttatgttcactatagaagatcccattaatttacaaatttatatatcgtgttaaactttttcttttatttttctattttaaattaaaaatggagaaccaacttcttaactcattcgtaaaagaaaaaatattgctagtagactaatggttcctataaaaattgtgctagataaaactagtactttgctgtatatagttgacttcttcccacatttttttaaatttcttacatagagaaaagctaaaagagctcctattagatttcctgttataacttgttggacaacagtaaattgtaggtatattcttaacaagctgggttcaattgttcttttttctaaaaaataaagaatacttgcttgaaataacattaaaaaaggaaataaagaaccaagagcgatatatggattatggaaaaaagcttcgtgtatcattccattcattctgatagtcattaatatagcatagaaataaaaaaggaaagctgcggctatccaataaccaagtaaaatgtgtttccagagtccttctatcctgtttcttctcatctagctctcctctctcagcgtatatacaccataagcacgaactaaataatccgctaagcaactcaagctgatcaatgattgaaatggtttattttcttttccaaggataaagcgattacaataataatttaaatgataagtactatggcgtgcgaaataattatctccagctgcagtaatggtcaaaactggaatcttctgtaattcaaagacagtcagattttctttgacctcatgtgtttcaccgctcaaagaaacaataatgaccatatcttctaatgttatcagtggcatggccatatcaaactccgtcttatttggcaacaccattactctctttccaatacctagcatcattttataaaactcattaattactttcttttgtgaaaatcccgttgcatagcaatagatcatcttacttcggtctaagcattgaaggattggctttaagttgacagccttcatataatgaagcgtctgctggatatcttccagttgtttttcaaaaatgtcttcttgtgttctaagtccattttctttgttttttacatgtcgtaaaaaatatttgaactcagaataaccagaaaaccccaatttcttagttgttctcataatggaagattttgagacataaagtctttccgctaagtcagttattttcaaattttgtatcaagctaggatccgataaaataaagttcaagattcctcggtctagttcgcttaatttttctgcatgttgatgaatcaatttttctagttccatacgattcctcctctattattagtatatgcaataacatgaaactattttttaatagaggaggaccacgatgtatttgggatactgctatttcaattcaggccagtactcttggtttacactcaccaaatcatctaatagatcttttgcaacttttgcgtttggaacaatctttgataatgtcagtgcttgccataatttctgataagacctttcttcccaagcttcgactactaatttttcgacagctacttgttgttccatcaatcccttttggaagcgtggaatctttccttgtatcaatggttctggtccattgctgccaactatacagggtatttctaccatcgccgactcatcaaaattctcgatagctccgttattaggtacgatcagcaacatcctttcatgagtgttataggcaattgctcgtgctaaatcaacgatatagctagcatgttcatcgatttccagtatcgtattttctgctgaaccactattagtgatacgatcacattcattaaatacttgtttttcgcgtccaatcatcacttcatttgcacgcgtaaactctgggttggtgtgcgctacttcatcttgcggataaaagtaatatttcaaataagtgttaggaagagtagttgggtcaatgtcatatacttcttttgctttcataaatgtatgtttccaacttgcatcggtttgttgtgattcttgagattccgatggtagagcgtaaccaaactgactaacatattcttgaattttaggcatcaaatcatttccttctgtatctcggatatccgtccaccaaccaaaatgattcaagccatagtagcgtacgaccatttctttgcgtgaagctaagccgatagcttgagccatacgctcttcaattcccaccggcatatcacatatattgatgatttttgctttaggacgtaattttcgagtcgcttctgccacgatcgccgctggattagagtaattgagcatccacgcatttggtgaatatttttccatataatctatcaactctaaaacaccgccaattgaacgcatcccataagcaattccgccaggtccacaagtttcctgaccaactaccccatacttcaacggaattttttcatctttttcccgcatcgcatataagccaacacgaatatgtgccataacaaaatcaacatcagtgaatgctgtttctggatcagtagtggctgtaaataaaatatctggtgctctttccttcaataaaatctcacacgcagaagcaatacgtgcttgtctttcctccagattgtcataaaatttgatttgccggataggaaatctatccagatgtttcaaaagcatcaaaacaattccaggagtaaatgtactccctccgccggcaatcgtgattgaaaattttttcatattaacatcccctttctatctgtctgttaagacttttgtgaaactattgttctatttctaataaacgttcaaattgttcacgtacttgtggcacgtccaaaccaactattacttgaaaagcattaccgtttctcactacaccgtgtgctccaccttctttaaaaatcgtatcttctaaaaccaacatttcattttttacagttattctcaagcgtgtagcacaatttgtgactttttcaatattgtcggcccctccaaaaccttctaaataaacagcagcttgattctcatatacattttcaatttctgtttttgaagttttcctctctttttctttgtaatcttttttagtatataatttaacagcgtcggtattctcttctcttcccatagtagcaatatcaaatttgagaatcaggtatcggaacacaacaaaatagatccctgtaaaagctagcccaatcactagttgagtaaagatcatccctttatggttttggaataatggaatccagactttcacgaacaagtcaataaatccaccaccaatatcccctaccacgccaaaaccatacattattgctgccattgtagcagccaaaaatgaatgaacagcaaataatggtggagatataaatagaaacgtaaactctaatggctcagtgatacccgccaaaacagctgtcaaagtagcggggatcaggatcgtcagcacctttttcctattctcagatcttgcagtgaagtaaaacgctgcggcaatacctggagaagcgaatatctttgaattcccgtgcaaagcaaaaccgccttctggaaaaagctgcttaagtggctgttcgctgcgagcaaactcctgaagatgtgtcatccagtatctcgcaatcccttcttctactactgctggaccaaatgcaaacggtgcgtaaataaaatgatgtaaaccggttggaatcaaaatacgttctaaaaaagtgtaaagccagacaccaaagataccagcacctgctaagaaaccttgcaatgaactaattgccaactggatcttgggccagataaggcagatcaaaaatgcaataggcaacatgacgaaaaaactgataatcacaacaaatgatgacccttggtagatccctaaaaaatccggcagctttttatcaaagaatcgattatgcagatacactacaacagctgaaatcaagattgcccctataattcctgtatccaatgttttgatacccgcaatcattttcagtccactcgcaccgcccgggtcggcagaaaaatcaacaccaaaaaatccgctataaaagcctaacatagtagaaatgaaataattacaagtaatatagactacaaatgcttccatcactgctctagcacttgcttttttagctaatccgataggtaatccaataacaaacaacaactccatttgattgaatacggtccaagcaccactttcaaccactgaccagatcgaataccatgctgttccttctgtagcaatactccccactaacattgggtttttgaagatgatacataaagccaccatgatacccgaaaaagaaaaaagcaaaaccggtgtaaacatagctccaccaaagcgttgaaccttttccatcataataataagtcaactccttccgtgcatatcttgtgtcgcaggtttagtataagtacaaaagaaaccggttacaatagctattacactttaagaaacttaatttcaataatagttcttaggtagcagataatgggaaatttccctaaatacataaacaaaagacagatttaatcaatgtatagaaatttttgtctacgcttctcctttaaccagagaaatttagaattatgctatactagtattaattaaagtgatgaggtgttttatatgaaaaagttagggtttattttagcgtcgatctccttattccttgtaggatgtacatctgctagtaaagaaaccagtgagtcatctgcgaccgcagtcaaaagttccatcagacaaactagttcagctgaaaaatcaagtacacagaaatcagcttcttctgaatcggatgcatcttcaaccaccagcaaactttcagagtccaacccttcttctatatctagtgatacggttgacacgagtctttcttcttccacagcagacacatccttctcacagtcttctcagtcagtagatccgttagcaggatattctgatctgcaaattgagtacgcacgcgtttggttggctgtcaagggtaatacttttaaagatgcatcaggcgattttgaactacatgttattcattatccggcaggaacacctatcgatccctatgatgcagggagcgtaggttatccaaaagacgtagttatgcttactgggaaatacggctaccaaggaattctagtgtattctagtaaccacgacgggacgatcactagttatccagttccttcacattggcaaatgcctgcagatcaagcctctgacccagcattcattaaaaaaacaactcaagaaatcattgatcatgcatctgtggttgttattcctacaggcaacccaaatgacgtgaaacagttaatcaatgtgacagttatagataattaaactttctaatatgttatacaaaaagaagctgacagcattttgtcagcttctttcactttcttttctatagtttttttgctggtctttgataggctggtccttagtgtgtcgaatggttgcatagatagtcttttctgcagaaacacttctagcattattaggaaatttaacgttattatcaaattgtaattgtgcataggttaattcttgctgttcattagaatgacttagtgtcattgattttatctgtgaaagatttttctttgtatcttgtttctcaaatttctcaaaatgacttgttgatccagcagcttgaacaacttgttttttcttttctcttcttactggaagtggaattttcttttttacgcctgtatcttctatttcttttttagcgagagcaggagcaactaattcatcaagtttttgcttaatatagcggtcattgataaatggtgaattcaaatttttcaaaaatgtatcgtatctagatgatactgttaatctattttttaatagatttaaaacagcttgcgtccaaactagcccatttttatgatagatttctaaacttttgctattagcggaagccttcagttgttgttcgaatacggaaaaatggttaacaaattctcttggttcttttacattcccaaatgtttttgtaaaaagacgtggatcatattcttgattgatatcaaatctactaaacccttctagtttatcttgtccataatctatacgtttcttctgaatatatacttcattaatataaggtgaccggaatttttctagaaaagaatcaaattcttcacggctattcaattttttctcgcaaagcttcaataaagcatcggtccaagataatccattttcatgatataaaagataatttttgttatcagttgctctgagttgcttctcaaatatattaaaataatattcaaattcacttggtctcttcaacttattgaacctttttgcaaacaattttggatcaaattctttgtaaatactaaaaccttcgaagtcatttatcaagttaactacatccataatctcactccattatcaaaaatatatcttacttatataaggatagcaaaacatctatttttattgcttcacaattagaactattttttcttaaatttgtaaaaaatcattaaataaaaactgttctcctatcaaatcctcagccacaagtcacaatagtcataaaccatgagaagctgtttttatttggctgttcgtattacttgatgcaagggagctttttcacaacctcacgtggaaaatcccctatattttttgctaaataaacgtttgcaaaacagtcgcttttccgtcttctaccgctacttctgcgtaggcaccgttgattaatgttagttgtggcggtacatgaccgcaatcaatatcatacaagattggtatgttcaattcttttgaaagatcttcatatacatccttcattcgataatctagcaaatcctctgctgcacttctgccgaacatgatacccgagctgtcctcaaaccatcctgctagtttcatctgaataagtgatcttcttaaatcaacggacgatagctcacagttttctagaaaccacaagattggctttccatcattatacgttcttttaaacgtttggacatctccataaggtgtaccaattaaatgtctgatcgtatctatacaaccacctaataatcggccttttatccttactacatctccgctgactgattgccaatttgttggttcagtaagatggaaaactgaagctgacggttgctcatgatgccattctttttgatatttttcagaagaatgctgtaagattgattctcctttgcctgtttctagcacacttttccacatcgctgtcgttttatctgaataattccctcttaaatcaataaggttggtcccatgtgcagtggctatccctgtttttaatgtgacggcgagtagcaacgtactaatatctgaataacctactatccattttggctgtagcgcatcgaaatcgacagaatcgaggatctcaatcaataattctcctccccaaggcggaagaatcatttggatattctcatcttgcatcatttgattgaattcatctgctcgttctcttgctggagctgatttttctttatcttgcgtccacagcgtctttccagtaacgacatgaaaagatttttcttccatactctttaaagccattcctagtaacaggtggtgttcttctggtacgcccgatgatggtgcagtaatccctatcgttgtgttttttcctaatgacggatatcttatcataatgcttcagctcctagtacgcactattttgtttgattagttgttattttcatttgctggcattaaaaacatcggtattttaagtagctggatgattttgtttaagtcaatcgttttgatgaccatcgtttgatctggtctccctggtgcaaaaacaagtttttcttttgacaatagttcttcgtcaataataatcggtatctgttcttcgtaaccaaatggagaaacagcgccctgtttttgtcccgtttgttcttccatccgttctgatgaaacaatagaaagccttttaccgatgatctttcctaatgctttgaaatccgtttgtttcgtagtaaaagtcagatatacatagttattatcttttttatcttttaagaataagcttttggtctctgtgcctgtaaatccttgctctttcttcaccaccaaagcatcttcatttgtataaatagctcgatgatgatacaactcaaaataaatatttgcgtgtgagaatttctttgccaagtcaatcatttttatgcctcttttctattttggtctttgagccatcttatcatcaaaatataccggatacaatattgcttgttttctaatttatttttatacataaccattgtttttctggtaaaataaatcaaaccacttaatggaggcgttttagaatggaaaaattccggctgattattgatcaaataaaagaaaaagaaaaccaacaaaagatcaatgaccttttctctaagatagcgaagacatatccccagctagacacaactgtaaaatggaaccagcctatctttactgatcatggtacctttattattgcattcagttttgctaaaaatcatttttccatcgcaccagaaaaagcagcgattcgtgcccttgaaaagactatccaagaaattggttacatatatacggataatgtcatcaaagttccttggaaaagtgcaatcaattgggaactgattgaccatttgatttcatttaatattgaagacaagaaagaccatgataaattttggcgataaagctttatacaaacaaaacctgtactggcgaagaatctatccattaccttgtacaggctttgttctatcctttttatcctcactggttaaacatttaattggcaacgtatctgctgcttttataaggagtctttcttgtgctgaaaaaaaatcactgatacgaatgaccttgaattttcaacttagtaaaattatttttcagcaattttcctgcaaatcttttgaataaggaaaaaatacgagaaaatatcagcaatctttcataatactatccattattttcaggtatatttaaatataatatcactttagaagagaatgaatttctttagagaaagaaaagttagaattttctgattcgttttttgcaatgactttaagtgagatcgttctttctacatctcgtgataaagcaactaacaaccaaaccaatagaaccattcacataggagggtgaacattgaaagatttttactcagtaaatgaattagccgaacaattaggtgttactacacgttctatcagaaattatcttcatgaaggaaaactaaaaggaacaaaggtcggcggacaatggaaattttctgaacgtaatctttttgaatttctttacggagatcaagcagatgaagcagcaaaagacatgcagcgattcatgctagatgcaccaatcacgatgcgtttcaaccttcagtatcgtgattttacagcgattaatcaattccgagaacaattagtccagtaccataacgatgtttacgcaaataaaaaagaccgtcttttacaatacgatctttataaagataatcatgcggagatacttataggtggtaattttaattatgtaacgaactttagtcaatggatcaatggaaaattattgatgcagacagatatttcacttgtttcttaaacgattaaaagtgctagaatttccaatggtgttggaaattctagcactttttataagtattcttttgctctctttatcctcaaataaagaccgtgaccatacttcctactacgatcagcaacaagccgataatcgttaattttttttcttttggtgtcttattttcatgcaggatgtacataccgcctaatgtagagataactacgtttagctgtgtaatgatatatgcagtagcaaccccattttcattcgctgaaaaaatataagccaacgctgacacactgaagatggctccaactattgttgctttccaactcttgtcttcagaaaatgcagttggttttcggaaaatcacataaataactgcccctaaaaagacaccgatcatttgcggaaagaaaatggaaagtccgcttgcatcaactagtttgggcaatgcactgtaaacccaataaccaatacttgttgatgctaatagactgattccttttgtgataccgcctttttttccaggatcatcactgattgccgttaaagcagaaccaaatacaagaagaatgatcgctgctgcaccaatgattttccccatacttccagaccattctccaaaagcgaagacaccaatcaacgaggttccgactaactgtaatgcagtcgagataggcatcgttttagaaacaccaatcaagttgaaagatgtatactgtcctgtttgtccaataacccaaaatgcaccagaaagtaaactaatcaaaaatgtagtcactgaaataccagctggagaagcgaataattgaacgagtaagccaacgagcaccgctccaataccagttcctaatatctcatttgttggtctgccgccaatctttttcaaaatcagcggctggatcccccacccaactgccgggatcaatgcaatcaataaacccatttttattcacccttatccttttccaccttggaaagaaggatataaagtcatcccaccatctgcaaatagtgtaatacctgtaacataactagattcgtctgaagccaaccatgcagctgccgctgctatttcttttggttcacctacgcgtcctagtgggatcatactttccaagagttctttttgttcaggatcatcaaattttgccgcattaataggtgtacggatagcgccaggtcctatactattgattctgattcccttaggtgcgtactccattgctaccgtttcggtaaataattttaccccgccttttgaagcagcgtaatgagcaaatgttggccatgggatttgttcatgaacagaagacatattgatgatatttccttttttatcattctctgtaaaataattcaaagctgctttcgttccgataaaaacgccagtcaaattaacttttaatactctttcccaatcttcaaggctaagttcatgggtcggatgctgattttccatcccagcattattaacccaaatgtccagtgtcccaaaattttctaaagccgtatcaagtaaacgctgtattccttcttcagaactgacatctgcttgtacagagactgcttttccgcctgcttcttcgattgctttgactgctttttctgccccttctttatccgaattatagttgacgactacattcattttttctttcccgaatcgttgagcaatcgctgttccaatcccttttgagccgccagttactactgcgactttgttttctaattccttatacatagtacccactccttttttatacctaaacctgttattacggataacttttatttccgccttaaagtgagtgtacaccaatatatatagtctaaagcaaatgatacgctctagtaatcgttttcatcaattggcagcatccttctatttttataaagaaagaggttgtgacagaagtggtcagcttcaagaaataagaaggaattgacgaaaattgcttttcaaatttttgtgaaatttcggcttatttccgaagaagctacttctggaacaccgtttattcggaaaaagggctgtgacaagacttttgccacagccctttcatgcacttatttatcaaccatttcgttgtaattgctagttatgcataaagattagctctcacggacattattttattgctgagaaaaatattcagctgttgcttgttcatcctccttgagttgttcaatcaattcctctgcacttgaaaatttcacttgatctcttaaaaattgattccaacgtactttgacgtgctcgccatagatatcttgattaaagtccaaaatatacagctctacagtcagctcccgtccttcaccgaatgtatcgttatgtccaattgaacccatggctggataccaagtttccccaatttttatttccgatacataaacaccttctttaggtaaatggactgtgctctttactttgacatttgctgtagggaatcctaataatctgcctcgtgcatcgccatgaacaactaccccttccacctcgtatatgcaacctaatagttttgccgcttcttttacttgaccgctgtctagcaatcctcgaatacgtgtagagctgattttttcgccttgttcttcttctttagagactgtgacgattttgaatcttcccttagcatattcaggaaaatgagcgacatctgcaatgtcttttggtccataggtgtaatcaaaaccggaaacagcatatttcgcatgtaatcctacgatatattgatcaacaaactcttgtggcgctaaatgagcaaaagaagaagtaaaatcgacttcatataaataatcgatacccaaagctgccattttttcttctttttgcttcaggctagtcaaatacttcacactgctaggatcgatcttcttaaaaacaatcgatggatgttgattgaaagtcatcaatgctaatttcaatccttctttttgtgcaatttccatacctgtctttatgactttctggtgtccgatatgcacgccgtcgaaaaatcccagtactaaaacgacatcgtcttctgggatttgttctggttggtaaggatgtctgatcttgatgatattcattcgttattcctcatttctcaatactttactaggttttagtttatttttttcttttgggtttggctggtagatacttacgactttttctttataaaacaaggcaatttcctctgaaggcatttctgggagcgcaaatacagtataatcaagtctcataccgttttttactttcttccatacctcatcagtaatatctactcgtttgaaccgttccactcctttttcaattggcagcaaatactcatcgattgtaccgttttctacagcttgagctacttcttctaatgttaacacttctttttgggtcataccggcacttgctgttcgagtgagatcagacatgtgtgcagggtaaccaagtttctttcctgtatccacagctaatgtacggacataggttcctttcccgcattctacttcgaaacgccaagaaatggttcctgccacttcgtctcttgtcagttcacttgttcggataaaacggtaaatttgagcctttctaacaggccgctccactggttcattattccgtgcatattcatataaccgtttaccgtttacttttaccgctgagtacattggcggtatctgggtgatctcaccaataaatgaagccatcacttcatctatttttttttcagataaagacatatccactggttttgtttctactcgttctccggatcgatcttccgtcgttgtactgaaacctagagtcatctcgcccacataaattttcccagaatctgtcaaatattcgataacttttgtggcttttccgatacaaataggcaatacaccgtctacatccgggtcaagcgtacccccatgtccgatttttttcgtatgtaagatttttcttaatttgaatacgcaatcatgacttgtcattccgcgttctttccataaaggtaataacccgtccatgtcttttctccatttcatttttgatttaactgaattattataacacattgcatctattactgacgaatttgacatcataatgaacggtttttatttttcggcaataaaaacgtaacaaaattcatgctcatgtaaatagaaaccatgttatgctttttttaaaggagggaatagaatggaagattttttctttgcaccatttgattggatttatgggtggcttacaggtaaatagattggttttcacttcccaaaaacgaaaaaaaagactggccattcttccagtcttttttccgttttttttatttattttttcagtttcttgatcaatgtaaaaaattctgtttttcggggtcgattttatcattttattggtcaagatttttccatttccaatccaatacttctggcagatcaataccattttcacgaatatagttttgatgttcttgtaatttctgatccattttttttgcaaaatcttctgcttgacttcctttgatttttaaagctgcatcttttgccaaatgataacggtcaagttcatttaccacacgcatgtcaaatggtgtcgtgatatctccgttttctttgtagccatgaatcattaaatgatggttatgacgatcaaagaaaatcgtgcggaccaatgtttcataaccgtggaaagcaaataagatcggtttgtcttttgtaaaatattggtcaaattcttcatcgctcaacccacgcggatcttgacttggatgacgtaatttcaataaatcgacgacattgatgaaccggatttttagttttgggaattcttccagcagcaaagtcacagctactaatgcttctaagttagattccgttcctgcagcagcaatgaccaattcaggttcctcctcttttgctgtcgaagcccaatcaatgattttcaagccttcattcactaagacggctgcttcttctgctgagtaaaattgagcacgcggatgtttggaagagatgatcaaattgattttttctgacgagcggaatgctttatccatgactgcgagcaatgtatttgcatccgcaggcagatattcacggatgaactccgccttcttttctgccaaatgtgtcaatattcctggatcttggtggctatatccattgtgatcttgctggaagactgttgagcttgcaatgagattcagcgaaggataatcatttcgccaagaaaggtcatgtgatttccgcatccatttgaagtgctgagtcaacatagagtcaaccactcgcaagaatgattcgtaacttgcaaaaaaaccataccgtccagtcagaacgtacccttctaagaacccttcatcttggtgttccgataattgactgtcgatgacgcgaccagatgacgaaagccattcatcattttctggttcgattttttccatccattggcgatttgtcgttttgaaaacttgattcaatcggttcgattttgtttcatctggaccaaatatacggaaattttctggatttttctcaatgatctcgcgaacgaatttaccaagttcagtcatatcttctgctttaacggagcccggttgttcaaattgcaaagtatattttttccaatctggcataataagcggttttggatcgatcccgccattggtgataggattttttgccattctttggtcaccagtgggcgcgatttctctgatttcttctaaaatacgtccttgtgcatcaaataatttttctggttcataggatttcaaccaacggagtaaagcatctgcatgatccatatgttcttgatctacaggaatcggtacttggtgtgctcggaaggttccttcaattggctccccgtcccattcttctggaccggtccatccttttggtgtgcgtacgatcaatactggccattttggcatcacgacatctgtcgctgtcttcaggcgagcttctttttggatggatttgattttctcgattgcttgatccattttttcagccataacaggatttaatttttctggatcatttccttcaataaagaaaggttcccagccaagtccgttaaagtaatttgctaattctccatctgatttacgtgccaagatcgttgggttagctattttagcaccatttaaatgaaggattggtaaaacagctccatctatcgccggattgataaagacatttgagaaccagcttccagctaaaggaccggtttctgcttcaccgtcaccaatcacgacagcagagattacttcaggattgtctaatacagctccgactccatgtgaaagagagtatccaagctctcccccttcatggatagaacctggtgtttctggtgctgcatgagaagcaatgcctccaggaaatgaaaatcgcttgaataatttttgcattcctgtctcatcttccgttacttctggatagatttctgtgtaacttccatctaaataagcattcgataccatgacttgtccgccgtgtcctggcccttcgatataaaacatgttcaaatcatatttattgatgattcggttcaaatggacataaataaaattttggccaggaatcgttccccaatgaccgattggatgttttttgacatcttctggtttcaatgtacgtctcagtaagggattatctttaagataaatttgcccgacagaaagataattggcagcacgccaccaagccgtcattttatcaaagtattctttactagaataatccatacgtaacactccttttcattattactcttattctagcgcagatactcctaattgaaacctaataagcacttctgttcatttgtttagattttatatcttgtcaataacttcaacgtgatttttcttttaactggcggcagaccgacaaattcaaacttttatggtgcaggttccactgatcttctagttacttggctatataacctgactgtcactacaatggattacaatctagcttccgtcatcggtatcttgatctttatctatatgcaaaaatttatatactatagaaaaaagaaagtcgaattttttacttttctttttctcttttttagttaactgacacgccgcaagactaaagtcatggaactcttaagtaatacgtcttaatgaaaacaaaaaaatcccgcaacccctgatttcacaggatttgcaggattttttgattagtctttgttcaagtcacgaagcaattcatcgatatggttgccatagacaactgattcatctaattcaaaggacaactcaggtgttttgtaaatacttagattgtgccctagctctcgacgaatcaatcctgatgctttatccaatccttcttgtgcttttttcttttcagatgctaaatcagaaaggatgctgtaatagattgttgcttgttgaagatcgcctgttacgtgtacatcagtgatcgttacatcttgcacacgaggatctcttacttttttacgtagaatcgcattgacttcttttaagatttcttgaccgactcggcggtcacgatagttagccataatgattggcctccttttatcagtttttagtcatttttgacttcttccatgataaatccttcaattacgtcatctactttgatgtcattgaatttttcaatcatagcaccgcattcatagcccattttgacttcttttacgtcatctttgaaacgtttcaaacttgccaattggccttcgtagataacgataccgtcacggatcacacggacaccgctgtctctgcggatatagccttctgttacatacgcaccagcgatcgtgccgactttggatactttgaatgtttcacgtacaatcatttgaccagtgattttttcttcaaattcaggatctagcattcctttcatcgctgtttcgatttcatcaatagctttgtaaatgatacggtgtaaacgaatatctacttcttcagcttctgcttgcgcttttgcttgaggtgtaggacggacgttaaatccaatgatgatcgcattacttgctgctgcaagtgttacgtcactttcattgattgcacctaccgctgaatggacgattttcacacgtacgccttcaacttcgatttttttcagcgaggcagctaatgcttctgctgaaccttgaacgtcggctttgataatgacgttaacttctttcaactcgccttctttcaagctttcaaacaagttgtccaaggttacacggctgcttgcagcacggttttccaataatgcacgttttgcgcgttcttcacccgctgcacgtgctgtcttttcgtcttcgaagactacgaaacggtcacctgcttgaggtacatcattcaagccagtgatttctactggcgttgcaggtcctgcttctttatcgcgacggccaagatcgtttgtcattacacggacacgtccgtaagtattaccgacaacgattgggtcacccacatgaagtgttcctccttggacaagtaaggttgacacaggacctttacctttatcaagacgtgcttcaatcactgttccgattgcgcgttgtgttggatctgcttttaaatcttctacttctgcgactaacaggatcatttccagcaattcttcgatgttttggccgaatttcgctgagatctcaacaaagatcgtttcgccaccccatgcttcaggaattaactcatactcacttaattcttgcataacatgttgagggtttgcacctggtttatcaattttgtttacagcgacgataattggaacgcctgctgctttggcatggttgattgcttcaacggtttgcggcatgacaccgtcatccgcagcgacaactaaaatcgtgatatctgtgatacttgctccacgtgcacgcatacttgtaaaggccgcatgtcctggtgtatccaagaaagtgattggtttgccatcaatatcaatctgataggcaccgatatgctgtgtgattccgccggcttcgccgcttgttacacgtgaatggcgcaatgtatccaataaggttgttttcccgtggtctacgtgtcccataatcgttactactggcggacgtgagactaatttgtctggatcaacttcttctgactcgaagaatttatcgatatctgcaatatcaacttggactttttcttgtggttccataccatagtccgtggctaacagttcaatcgtatctttatccagtgcttggttttgattgaccatgacgccaagcataaataattttttaatgatttctgctggctcacgatgaatttttttcgcgatgtctgctacgttcatgccttcagtatactctaatacatctggcaattcacggaatttgcgtggtggtacagctggtttagttgattgttgctgtttgccttttttaccctttttattataacgattacggttgttattattaaatttgccgcgattgttattgtttggtttgttgttggtacggttttgattgccgccttggctcgttcctggacgattttgactgctagtattccccgtattattttggtttgttgttggtttttttccttgattcacttgaccgctcccttgaccgcgatcttgataactgcggttatttttatttttttgttgattatttgttgcttcttttttacgttgatcgttcggctgttgattggctggttttctgcttgcttgttgtgcagcttgttgtttcgtgcttgggtttttgaacgcttgttgcaatttcttctcatcactgctagtaatcgcacccatatggtttttcacatcgatgccaagttgttgtgctttttccacgacatctttactagattttttgagttcttttgctaattcatagattcttttattgcccatgcaatcaccttcctaaccttcaattagctccttggtcttcttcgcaaatccggcatccattattccgaataccttgcgaggttttccgatcatctgcgtgatttctgcttcagaaaatagctcaaagcaaggaacttcatagtatgaactcttatcttttatcttttttcttgtattctcacttgcatctgttgccacaaacaccaattttgctttttgtttgcggatttcagcaatggtcagttcttcgcccgtgatcagttttcccgcgcgcatcgccagacccatgagattcatggctttttgccgattgactgtgttcattttccaaataactctttacgtgctttttggtgagtgacatagtcaagtagttcttgataaaactcatctgttaaagttgtttcgagtactcgatcgagaatttttttatcccaagcttgttgtacttcttccggctcaagtgagacatacgctcctcgtccaggcatttttccagttggatcgatcgatacttccccttcttttgaacgggtgattcggaccatctcttttttaggtttcatttcacctgaaaccacggatttgcgtaaaggaattttcctttgtttcatctctttgcctccttactaaagttaagcttctggcttttcttcgaccgtttcattattgaacgcaattgtttcatactcatcgtctgtcaaatctgactgaacgattgcttcgtcatacaattcttctgtttcgttttgttgttcttgtttttcataaaattccgccatatcagattctgatttgatatcgattttatggttagtcaatttagcagctaaacgtgcgttttgtccacgtttaccgattgctaacgataattgatagtctggaacgaccactgtgcaggctttaggattggtttcatcaaaaatcacatccatgacttgtgcaggattcaatgcatttgcaatgaatacagctggatcttcattccattcaacgatatccatgttttcgccttttaattcattgacgattgcttggacacgttgtccttttggtccaacacatgtaccgactgcgtcaatgttctgatcgtttgaacggacagctacttttgatcgatcgccggcttcacgagcaatgctgacgatttcaacgattccatcataaacttctgggacttcttgctcaaataagcgacgcaatagatccggatggctgcggctaacaaatacttgcggacctttagacgtattttctactcgagaaacatagactttgatacgatcgtgaggttggtaaaattcgtttggcatttgatcttgtttagaaagaactgcttctattttgccaaggttgacataaatataacgtttatcctgacgttcaacgattccttgcatgatgtctttttcataagcactgaattcgttataaatgatcgttctttctgcttcacgtacacgctgcaagataacttgtttagctgtttgtgcagcgatccgcccaaaatcttttggtgtgacttcaaaacggatcgtatcaccgatctcatatgctggattaatcaaaagtgcatctttcaatgagacttccaactgtgaatccatcacttcttccgttacttcttttactgcatagacatggatctttccttttttctgatcaaattccacttcgacattttgtgcttggccatagtggcgtttgtatgcagaaaccaatgctgcttctaaagcatcgatcacgatttcttttgagatccctttttcagcttctaaagcgtctaacgcatttaacatttctttactcattttttctgattcctctccgtgattaaaattggatagctaagcgagcttttgcaatattttttcggtcaaaagtcaattctttttctcgtgtttttatgcgtattttcaatgtaagctgttcagcatcaaatgattgaagaaatccttcgtattgtttttcgccatctactggttggtataaggagacatggacataatcgccaagtgccttttcatagtcgctttcttttttcaatggccgctctgctccaggggaggatacctccaggaaataagcttgaggaatcggatctggatctgctgcatcaagtttttcgctcagtttctcactgacaaaggcacattcttcgatatcgattccgccttctttgtcaataaatactcgtaagaaccagctttttccttcttttacaaattcgacttcgacaagttcaaaatgttgttcatctaaaatcggtgtcaccatttccgtgactgtttcaacgacgctactcaaaagtttcgcctccttaaaaattaagtgcgtaattccattaaaaagagtgagcgaaaaatccgctcactcacagttagtatcattacctataaaaaatataccatactctgcttaaaattacaagcagacaagataacagatgcttataacatatcgaataacgataattggttttcgtctggtaaatccttcaatacaccattatcgttcatatattcgatcaatgtttttgaaactttcccgcgagtagcaagatcttctttagataaaaatggaccatcttttcttgcctcaacgatttgttttgctacattggttcccaaactagggacagctctaaatggcgcaatcaacgtatctccttcgataacaaaattaactgcatccgatttgtacagatcgatcatcccaaatttgaatcctcgctctaacatttcattggctaattctagcacggtcagctgatttttttcttttacggaagcatctagccctttgtccgtgatttctttcattgcttgtttcacagcatcttttcctttgcacatggagactagatcaaaatcatccgcacgtacagaaaagtatgcacagtaatacaaaatagggaaatatactttgaaataagcaacacgaagagccatcaatacataagctgcagcatgggctttcggaaacatatacttgatctttgaacaagaatcgatataccaatcaggcacattattttctttcatcgcggatagataggtttctctcaattcatcaggaatcttgttccattgccctttacgaacagtttccatgatcttaaatgccatcccgctgtctaacccagcatgaatcaaataaaccatgatatcatcacgacagccgattacttccgccaatgtcgcatccccacgtcgaatcaattcttcggcatttcctaaccatacatctgtaccatgagatagtccggatatttgaagtagttctgcaaaagttgtaggatgtgtttcttctagcattcctcgaacaaaacgagtgccgaattctggaatacctaatgttcctgttttagaataaatctgttcctgggttacccctagtacttcagggccagcaaatattcgcatcacttccgggtcatctgtgggaatcgtttgtggatcaatccctgataaatcttgaagcatccgtataacagttgggtcatcgtgtcctagaatatccaatttcaatacattatcgtgaattgagtggaaatcaaaatgggtcgttttccattccgaattttgatcgtctgctggatattggatcggcgtaaaatcgtagacatccatataatctggaataacgataatccccccaggatgctgaccagttgtccgtttgactcctgttgcaccctttgccaatctgtcgacttctgcacttcgaaactgcagattattgtccctttcataaccttttacatacccatatgctgttttatcggcgactgtaccaatcgttccggcacggtaaacatagtcttcaccaaacaatactttcgtatagttatgtgcttctgcttgataatcacctgagaaattcaaatcaatatcgggcactttgtctccatggaatcctaaaaatgtctcaaatgggatatcatgaccatctttatttaagcgtgcaccacattttggacattgtttttctggcatatcaaatccagaaccgtacgtgccatcttcaaagaactcggaatattggcactctggacagtaataatggggagctaaaggattcacttcagtgatcccagtcatcgttgcaacaaagctagagccaacagagccacgtgaacctactagatagccatcttcattacttttatgcacaagtttttgggcgatcagataaataaccgagaagccattaccattaatagaattcaactctttttctaatcgtttttggataatttcaggtaacggatctccgtacatttgttttgcttttgtgtaactcaattctgatatctcatcttctgaacctggaatcttcggtgtataaagctcatctttgactggaatcacttcttcgcagatatctgcgattttattcgtattatccactacgatctcttttgctgtttcttcccccaaaaagtgaaaagcggtgagcatctcatcggttgttcggaaatggacatctggcaaactatgacgattcaacggattcgctccgcccatagaattgatcaaaatttttcggtaaatggcatcttcttcgttgagataatgaacgttacctgttgcaacaacgattttatccaaactttttccgatttctactaagttttggataatttcttccaaatcatgttcattttttaccaattcttgctcgatcaaaggtgcatagaccgcttttggcataacttcaatataatcgtagaattttgctcggtttcttgcctcttctacccctttttgcatcatggcttcgaagatttctcccttatcacaagctgagccgatcaatagattttcccgcatctttttcaattgggagcgtggtattcgcgggacacgttcgaagtattcgacattcgacattgaaatcagtttgaacaaatctttcagtcctgcctgattctttgctaaaatcgttacatggaaaggtcgggctcgtttgtaagaatctccttctccgatatgctcatttagctgatcatgataaagcatgtgatgattgtccattgcctctttcacaaagatccaagctaaatgacctgttgcttcagcatcatagattgctcggtgatgctgttccaagctgacaccaaattttttggataacacacctaatccgaaacgtttgaattgcggatatagatatctggctaattctaaggtatcaataactggattggctgcttcaggaatgccatatcttgcgtagctagtattcaagaatcccatatcaaaagccgcgttgtgggctactagaattgtaccttttgaaaattcaaggaacatccgcaagacttcttcttctgacttcgatcctcgaaccatttcatccgtaatacctgtcaaatccaccgttgttcgggataaaggatgtcctggatcgataaattcatcaaagctttcgatcacatttcctttgtacattttgactgcagcgagctcgatgatggtatcgtataccgcagacaatcctgtcgtttccacgtcaaatacgacatatgtggcttcgttcaatgcttcatgcgcatcattataagcaataggtacaccatcatctacgacattcgcttccacaccgtataagattttcacgcctgcttttttcccggcactatgagcttctggaaaggcttgtgcgccaccatggtctgtaatggcgatggcacggtgtccccattttcctgcttgtgccaccagatcagaaatgctattcgttgcatccatcgtactcatattgctgtgaacatgaagttctacccgtttttccccttcaggagcataatctttacgaggggtatgtttgacttcaacgatatcttgggcattcatgaccaaatcacggacaaacgtatcttcttggatacttccacgtacctttagccaactgccgacactgatcgcatcaaatatctgttcatctttttcgccatttgagaattttttgacgataaatgatgaagtataatctgtgattttcaaagtcaagatcttgcgttttgagcgtagttctctgacttctttatcgaacacatacccttcaagagtgactcgccgttcttcttcgacgatattgatcattggtgttgtgggctcatctgctggaatatttcgtcctagctggatgggtccttcaagagctggtgactgttcttttctttcttttttcttttgctcatgaacaactagactttcagctgcttgcttcataaaggcttctgcctgttcttgtttacgttcttcaaaaagtttcaatacacgttccgcttgctgctcatccacttctggttcgatacgaaatttcgggaatccgtaactgacgaacaactcttctactaacggtaagtattgctgtttcaaatatgaaatagcccctgtactgtcgattggcaagatgactttacgatcttttatcacaggtacttgcgttttcaatacttgctgtgctagtggtgtatcgcattgctgattttccaaagcttgggcccagtaatcttgcaagagctgttcatcgaatgtctggtcatctgctaagatgttcaatttgacttgtgcaatctctttaaaagcgacagtcagatgctgagccaatgaccgatacagcataataggcaaaattttagaaaaatgcagcgtaaattcccataaacgcgatttacgatggaccactacactatccatttcaccagcagtaagcagtggatgatttttttctgcttcctctagttggatttgttccaacagtttttcaaataaatctcgtttttctgacaaagatatacgccctttctgatgagaaactatgcaattgattacatcgtatcctcttctttttcagtaccttttagtatactcgttttttctgagttttacattaaaaaattggaactgtgattcacatcacagttccaattttaaaagcgaaacatcaggttgtcaaaaacagctgattcagctattttacttttctgtgttttaacgcttattattcgccttggttcaagaggattggtaaagtattcgccaattcttctttacgtacttcaaccatttcgccagttttcttgattttcacttctacgattccatccactgcttttttaccgacagtaattctgattggacagccaatcaaatcagaatccgcgaatttcactcctgcgcgttcatttctatcatcaaccagtacttcatagccagcttttgtcatcgcttcttctagttcattcgtcaagtttgtttggtattcgtcttttagattcatttggacgatatgcagatcaaatggcgcaattccttttggccaattgattccttgttcatctgaatgttgttctacgattgctgataataaacggctcacaccgataccataacagcccataatcacaaatttttcccgtccgttttcgtctagaacggttgctcccatagattcactgtaacgagtgccaattttgaagatatgtccgatttcgattcctcgagtaaaggcaagaacaccgttgttgtctggtgaaggatctccttcttgtacaaaacgaagatcttcataagaaagcacagtgaaatcgcgttctggattcacatttttatagtggaagcctgtttcgttcgctccagtaatggcattcgctaaatcttggacataacggtctgcatatacttttacatcctctgaaacaccgattggtccgacagaaccaaactcagcacctagatatttttgtgcttcttcttccgtcgcttcttctaaaaagtcagcagatagatagtttttcagttttacgtcattgacttcatggtctccgcgtaccaaaacaaggacaggttgttcatccgcaatgaacaatacagacttgatgattttttgaggttcaacagaaaagaaatctgctacttcgtcaattgattttacgttaggtgtagctactttctctaattcaagctgtgtttcatgcgatttttttgacacatagtagcttgtagccatctccaagtttgcagcataatcactttcagtcgaataacagatcgtatcctccccgatctctgagatcgccatgaattcctttgagtctttcccgcccattgcgccaccgtctccgatgatcgaacgaaattccaaaccgcaacgcttaaagacttcggtataggctttttcataatctttatacgtttcgtctaaactttcttccgttgcatggaaagaatatgcatctttcatgataaactcacgtccgcgaagcaaaccaaagcgaggacgtttttcgtcacgatacttaggttggatttgataaagattcaaaggtaatttcttatatgaattaatttcattacgcatcaaatcagtaaaagtctcttcgtgagttggtccaagaatcatttttcgatcattacggtccttgaaacgatacaagtttggaccatatgtttcgtaacgtcctgactcttcccaaagttctgctggcaagatagcaggcatcagcatctctaccgcaccgattttttcaaattcttcccgcatgatacgtttcagcttttctaatacacgatttgctaatggcagataagaatagatacccgctgatacttgacggatatatccagctcttagcaagatttgatgacttaatacttctgcatcatttggaacttcacgtaatgttggaatcaacatttttgattgtctcattctatatactcctttatttcctcaaaatagttatcgtttgttattataccctatttgtcaactttttctagaaaaagaatcgttgaatatcgttccatgtaactagcaccatcaacaacattaaaaatccaaagccagctaatgtcaatattccttctttttcttgacttaatggtttcccacgaatcccttcaaaaatattcaacactaatttcccaccatctaaggcagggatcggaagcagattgacgattccaaggttcattgaaagaagcgccatcaaaccaataacagttgttacaccttggtttgctgcttctgaagataattggtacatcataacaggtccgcctaatttatctaaactaaaacctgtaaacagtgatcctaaggctttgaaaatttccaatgaaccgctaaaagcttgacgtgttccgccgatgatcttatccataaaacctgtattcattggggcttgtatgccaagttggccaactttttcgccatttgactctacagatttcggtgtcacgtcgacagattgcatcttaccttctcgttcgatctcaaaatctaatgttttacctggatttttcgtgatgactgttgtcaaatcgttccaagtgtggatttctttaccgtccacgctaactaccttatcattttcttttaagcctgcttctgccgcagcaccattagggataatctctcctacacgattagtatttgtcacttgaacaccgccttgcatgaatgcaagaataataaataacacgattgccaagataaagttattcattggaccggcaaaattggtcagcatacgctgccacagtttagccgattggaactgtacatcttttggtgcaattctgatttctgttccgtcggtttcaataatcgtcgcatcgtgatcgacaggataggtcactacttctgtttcatctccattcacataaccagtgatagtcagctcatcttctaaatcataacggctcaattccattgggatagcatttgtcaattggattttcttacttaaatttatcttctctacgatgccgtcagaatttagtaaaagagaaagaggcatacctggtgccatttctgtttcatcatccccattgcctgccattcgaacataaccgccaataggtaataggcgaagcgtatatgttgtcccgtcttttgcttgatgcccataaattttcggacccataccgatagcaaattcgcgaacgaggattcctgatcgtttcgcaaagaagaaatgaccaaactcatgaacaatcactaatataccaaaaacaatgataaatgttagtatcgttttcatagcttttttctcctttacttgttttttgtgtgtttttttaaacaacgttaaaacactataattttaccatagtatacctaagacaccaatagtatcaataaaatgagaaacaaaaacctgcgtcttttatgaaaatcacaaagaaacgcaggtatacttactaaataatgccaaataaatgcatgataggaaatacaaacagcaagctatcgaaacggtctaagattcccccgtggcccggtaagatatttcctgagtctttcacatcataatggcgtttgattgctgattcgaccaaatcgccaaattgtccgactgccgaaaaaataatcgtcatcagaagcatgacaaacataccatgattgaatagttcttttgctggatacaacaatagataaagaaatgcgactacaacagcacttccgatcccgcctaacgcgccttcaatcgttttgttcggtgaaatatccggacttaacttgtgttgtccataacgacggccaaccatataagcaccaatatcagttgcccaaacgataaacagaccaaaaatcaaaacagctaaactttctgttcgtgcattgacgaaattctggaagcctattcctacatacaaactgacaagtactgggaaacctgcttcatcaatcgtatacgtatttttagatataactgacgtccctaaaaggatcataacgataagataaaatagcataaatgtactgacgttctctggaagaaagaagaaccatctttcttttggcaagacaaggagcactgcaccaatagcggataaaactccttcaaaacttaggagagtcaatcctttcatccggaaaagctcataaactcctaccacagctaagactgctgcggtaagctcaaccgctatgcccccaatccatataatcggaataaacaagacaagcgccacggctgctgtgattacacgttgtttcatgactgatcccctttctcattttctgttttttttacaccgccgaatcgacgatctcgattttgataagaggcaattgcttcttcaagatgtgcaccgtcaaaatcaggccaaagtgcttttgtaaaatacaattcactatatgcaatctgccataacagaaaattactgatccgctcttctccgcttgtacggatcatcaactcaggatcttgtaattctttgggcaagaaacctgtcattagatggttggcaatcacttcatcatcgatttcttctgcctgtatttctccctttgctacttcttcagcaatgttttggactgcggtcacgatttctgctctgcttccgtaattcaaagcaaagtttaacaccattccggtattgtcttttgtttgctcaattgcacgttttacagcgtcttgcgtctgttctggtaacacgttctcataccccatgacatggactttgacgttttctttgatcaattctggtacgaacgtatcaaaaaagtcgacaggtagttgcatgagaaaacttacttcatcttttggtcgcttccagttttcagttgaaaaagcataaagcgtcaatactttcactccaagccttgatgctttctttgtgactttctttactgtttccataccttctttatgaccagcgactcttggcaaacgccggttttgcgcccaacgaccattgccgtccatgatgatggcaacgtgttgaggaattggtccatcggcattaaattgaaattcgcttttttcttgaatatatttgtttttttgcggaaaaaaacgtaacattctttttcctcctatacttaaaagattcccactatcttaagtattatagcaatatctaaacgtttttcctatgaaatcattgtttttttatttaaaaactgaataattttttctttttttaatctttaaataaaagaaacataaataaaaacagaggaagcggaatgatccgcccctctgtttttatggttttattaaacttccaataattctttttctttatcagcagcgatcttatctacttctttaatgctgttatctgtcaatgtttgtacgtctttttctagtccacgcaaatcatcttcggtaatgtcaccatttttttgttgttttttatattcatcgattgcatcacgacggatgttacgaatcgcgatttttgcattttctgcttcttttttcacatctttagctaattcttttctacgttcttctgtcagttgtgggataaccaaacgaataacatttccatcattggtaggactgattccgatatcacttgccataatagctttttcaacatcttgaagaatgctcttgtcaaaaggcgtgatcattaaaacacgtgcttctgggatttggattgacgccatttggttcaatggagttggtgcaccgtaataattcacagtgattcgatccaaaaggctagcattcgcgcggcctgcgcggatttgcccaagttcacgttgaagattttgtgctgcttttttcattttttcttttgcttctgtcataattgcatctgccatttttatttcccccttacagtcgttccgatattttcacctaagattgctcggcgaatatttccgtgttcatttaaattgaagacaagcaatggaatgtcattatccatgcttagtgaacttgcagttgaatccatgacttgtaatcctttagcaatcacttccagatgagtcagttcttcaaatttcactgcatttgcatctactttcggatcagcagaataaacaccgtctacattgtttttagccatcaggataacatctgcgccgatttctgctgcgcgtaatgctgccgttgtatctgtcgagaagtacgggttgccggtaccgcccgcaaaaataacaatccgtcctttttctaaatgacgttctgctttacggcgaatgtatggctctgcgatttgacgcatttcaatcgaagtttgcacgcgtgtcggtacacccacgttttccaacgtatcctgtaaagctaaggcattcataactgtagctaacatacccatgtaatcagcttgagcgcgttccatgcccatttgtgctccgatttgtccgcgccagatatttccgccacccacaacgattgccatttcaacgcccagttcgtgaacttctttgatttcttggatgatttctttgattactggtggtttgattccaaatcctgcatccccagctaaagcttctccactcaattttaagactacacgctgatatttcggtgtgaccatgttcattcctccaatattttctattgccattttaccatacttagatgatttcgacacgctaagcctggtttttcttgttttgcttaaaaaaagggagcgcacaaagcgtgcgttcccgtctgtcattcaacagaattattttttcacttggctcataacttcttctacaaagttatcttcgcgtttttcgataccttcgccaacttcgaaacgtacgaatgttttaacagttgcgccttttgaagcaacgtatttttcaacagtcatatcaggatctttaacgaatggttggtcaaccaaagcgatttctgctttgaatttcttcaagcgtccttctaccattttttcaacgatattcgctggtttgccttcattcaatgcttgttctgtaagaacagttttttcatgttctaattcagcttctggaatttgtgattcgtttacatagcgaggattgatagctgctacgtgcatagctacatctcttgcaactgtttcatctgttgttccgtctagaacagtcaatacagcaatacgtccgcccatatgcaagtatccgccaaatgcagcattgtcgtctttttctacaacttcaaagcgacggaagctgattttttctccgataacttgagttgcttcgatcaaatcagattcaatcgttcctttatctgttttgattttcattgcagcttccatgtctgctggtttgttttcagcaacaagttctgcgatttcttttactaagtcttggaacatttcatttttagatacaaagtctgtttctgagtttacttcaacgattgctgcagtgttacctttcacagcaactgaagctaatccttcagcggcaatgcggtcatttttctttgcagcctttgccattcctttttcacgtaaaagatcaactgctttttccatatcgccttctacttcaactaatgcttttttcgcatccatcattcctacgccagtcatttcgcgtagttcttttaccattttagctgtaacgtctgccatgtttaactcctcctgtgtgtgttctttttaaaaaaagctgtttcaaaggagagtgaggcttgtcgcccagcctttgaaacagctccatcattcaaaattattctgctgaagaattgtcgccttcaacaacatctacgatttcttcgattgatgttgctgtgttttcttctgtgaaatcttcttcaactacttgatcttcaccttggtttccttcgatgaaagcatcagccatttttgaagtaatcaatttaacggcacgaatggcatcgtcgtttgaagggattactacgtcgatttcatctggatcgcagtttgtatcaaccatagctacgattgggatatttaatttgtgtgcttcttgaacagcaatacgttctttacgtgggtcaacgatgtacattacatctgggattcttggcatatcagcgataccgcctaagaatttttcaagacgttcgcgttctttgttcaaaccagcaacttcttttttaggtagaacttcaaaagttccatcttcttccattgcattgatttgtttcaaacggctgatacgtttttggatagtatcccagtttgtcaatgttccgcctaaccaacgatggttaacgaagtattgtcctgcacgagttgcttcttctttgattgcttcttgtgcttgtttttttgtacctacgaataatgctacgccgccttcttcagcaacgctcttcatgtaatcataagctgcatctactaatttaactgttttttgtaagtcaatgatgtagattccgtttctttctgtgaagatatatttcttcatttttgggttccagcgacgagtttggtgaccaaagtgtacgccggcttctagtaattgtttcatagaaattactgccatgtttgtttcctccgatttggttttattttccctcttcttatcttctaccttgccggcaaactttttcaagcacctaccgacaatccaataagaatgtggatttgctgatgcataaagcaccctcagctattatacagacaaaagatccatatcgcaagagcaaatgtacttttctgctcaacattcaatagtttacctgaaagacaaaaagaattcaagaaaaacagtagatttctctttgtttctttattctcttttttccataaaataattttagatataaaagacgaatattattgggcaatccttcttttttttgttatgatacatgtgaaatctttcgtaaaggagaaagaaaatgcgcaaagctcaaagacatttgctgattaaacaagtcattgaagaattcccgatccgtacgcaagaagaactattaaacaaacttgggcattatggcgttaccgcaacgcaagcaacgatttctcgagatatacgtgatctgaaaatcgtgaaggcacctgatgaaaacggtatttcccgctttgtgttgtttcgcgaaaaaggtactcctgatactaagactgaagaagaggatcggctgattcaaatgattgaagacattgtgttgaaagtcgaacgagtccactttttgacaatcgttaataccttgccagacaatgctcatttatttgcatctgttttagatgagatcaagcctcctcctatcgtcagtacgattgctggatttgatacgatcatgattatctcagaaaatgaggaggatgcaaaacgagtagaagaatttcttcaccatccgactgaagtatcacttttttaatcagagcacgtgttcctaataaggaatgcgtgtttttttattttcaatattttccttgttaaataaacctttacactctttacaaaaatacatcagtttttatttaaaattttcataactttgattaaatcacaatactcatcatttatattggatgttagcaagagcagagtcttgctctttgtgtatgtcaataaaaaagaaatgaaaggaaatcgcatgtataaattattaacgcctggaccattaacgacttctgaaacagtgaaaaaagcgatgctgaccgatcattgtacctgggatcaagaatacaaagagatgacacaatggataagaaaaaaattgctggagcttgctcaagtaccggaagaactatacacaacggtcttgatgcaaggcagcggctcctttggggtagaatctgttttaagtactgtgattagaccagaagatactttgctgatttgttcaaatggcgcatacggtcaacgaatggttgccatgtgcaaatatctgcaactaaactatgcagtttatgaagtacctgaacaccaaatcccccaagcacatatgattacacagttgattgaagagaatccgtttatctccgcacttgcaatggtccatagcgagactacttccggtattttaaatgatttggaagaaattgctactgtcgtacaggaaagaaatcttttgtttatagtagatgcgatgtctagctttggtgggataccgattcatgtagcggaactagggatcgattttttgatttctagctcaaataaatgtattcaaggtgttccaggtttttcttttgtacttgctaataaagtggaactagaaaagcgaaaaaatgtgagtcgaagtttgtcacttgatctgtatgaccagtatcgcgtgatggaaaacgagaatggcaaatggcgtttcactccccctactcatacggttttggcttttcaacaggcattgaaggaactagagctagaaggagggatcgaaactcgatattcacgttatctcgccaataatcatgtgctacgacaaaaaatgacagagatgggattccagcctttcatccaagagtatcaggggccattcattacctcttttctttaccctaaagactggcgatttgatttcaatcatttctatcagcatttaaaacaaaacggatttgtgatctatcctgggaagatcagcgatcatgaatgttttcgtatcggtaatattggcgagatttatccagaagacattttagaactgacagcaattatcaaagactataaggagaacattaatgattaaaactgtaatttttgattgggcaggaacaactgtggactttggctgtatggctcctgtccacgcttttagaaatgcttttctagaaaaaggaatccaactgactgacaaagagatccgcgaaccgatgggaaaattaaaatgggatcatatccaacagcttctttccctcccttctgtcaaagaacaatggatagcgattcatggacaactacctcaggaaaaagaggtggaggaattgtatcagcaatttgaacattatctgtttaaagatttggcccagcattctaccttgaaacccgacacattggaaacggtcgagcagttgagaagcgctgggatcaatattggttccacgactggatttactgctcctatgatggcaatcgtagcagaaaccgcaaaaaaaggagggtattcaccagactttatggcaacttctgaagacgtcgaaggatatggacgaccatttccttatatgattcataaaaacatacaacatttcaaaaacaagtcggttgatgaagtaatcaaagttggagatacggtctcagatatccaagaaggaaaaaatgctggggtgtttacagttggtgtgattgaaggtagttcgctgatgggactttcatatgatgcataccaacaaatagagatggaggaaaaagatcgcttaaaacagtctgttgctcttagattccaacaagctggtgctgatctttgcgtaaataacttaaaggagttaacagagtacattttgtgcgctgacaagaatccagaatgacttttattcgcaataagggctgtgacaaaaatattgtcacagcccttattgcgaataaacggtgttctcctgccaactcctcggtcacaagtcacaatatccaacaaacacgagaagctgttttttgaaattattccttgtgactcggagctgatcactgatttcacattctttttttcttacatcttatctggtgcatgaagtcctagcaaacgaagatcttctttcaataatacagtcactgcatacactaaagctaagcgtgcttctttttgttcatcgtcagctaaaattttcgtatgagcatagtatttgttgaatgcctgtgctaatttgattgcatgtttcgcaatcactgaaggttcatatttttccccagcggataagactgtttcaggatatttttgaaccaatttgactacttcccagctgatatcgtcattcaacgcatagtctgctgtttctgaagggacgaatcctgctttttccaacagactgactgcacgagcatgtgtatattgcacataaggtccagtttctccttcaaaacgaaccacttcttccaagttgaagtcaaatgtattgagacgatcgtttttcaaatcatggaagatgactgctccaacccctacttgtttagctacaacatctttgttttctaaatcagggtttttctcgctgatctgttctttagcagattggattgcttcattcaatacttcttctagtaagacgatttttcctttacgagttgataattttttaccaccttgtgtgatcaaaccaaatgggatatggtgcatatcgtcagaccagtcaaagcccatttctttcaagacagctttcaattgtttgaaatgataactttgttcattccctactacatatagagattgcttgaagtcataggtacgtttacgatacaatgcggcagctaagtcacgtgtgatgtatagtgtcgcgccatctgatttcttgattaatgctggattcaagtcgtaagcagaaaggtcaacgatctccgcacctttatcttcgttcagcaaatgtttttcttctaaaagttcgacgatttcatccattttgtcattatagaaagcttcaccgttcaatgaatcaaactgtacttctagtagatcatagattttgttgaattctttcatcgattcatcacggaaccattgccacaattggatagcttcttcatcgccttcttctagacgtttgaaccaagcacgagcttcttcatttaattctggttctgtttcagctacttcatggaattggacatacaaacgaagcagttcattgattggctctgctttgaccgcttcttctgaaccccattttttgtaagcaacaatcagttttccgaattgcgtgccccagtcacctaaatgattgatgcggattggctggtatccgattttttccataatgaagccaatcgaattaccgataactgtcgaacgtaaatgtcccattgagattggttttgcaatatttggagaagacatatcgatcggtacggtcccttgattcccaatattgctatccccataatgttctttttctttcactactgtttgcaaaacttttttgctgataagttctttattcatgaaaaagttcaagtaaggtccaaccacttcgattttttcaaagttggcagagtcgattttttctgctaaatctgcagcgatttgctgtggcgcttttcggtaaacttttgctaatgaaaaggctggaaatgccacatccccgtgttcggctgattttggattttctagtaattgttcgacttgttcaagtgtcaaatcgtctttgacaacgtcatagacagcttttgcgacaagatctttattattcatctttattcctcctaaaatactctcttatttgttcaacaaaaaaaatctctaatgacgacatacttagtatgccatcattagagacgagatttcccgcggtaccactccaattgtcctaaaaaaggaccagctccatctgatatcggtagacgaccgtctgtttaaaacagaattctccaagtgcgcttcgttgtatctccttcattcggcttccaccacttccgaattcgctagctaagaatgatacaagtactctcttgttcaacaaatcttaatcttattaaactttcttgaattatatcagaaaaaaaaacgaaaggctagtcgtttctaataaaaaaaacaatccagatggcctaaaggagaagaaataccacctggatagttataaatcatttcgtaaatacgaaagacttaacaaattaatcagctacgataatcgttccttcttcagaagctaaaagattttcgatattttctaaagaagtgatgattgccttagcgttcggttttgcttcaacaaatgcaatagctgcttctactttcggaagcatgcttcctggagcgaactgtttttcatcaatgtattgtttcatttctgaaacagtaacagtttctagtttcttttgatccggtttttggtaattgacatacacattgtctacacctgtcaaaacgatcagcaaatccgcatcgatgatttcggctaatttttctgaagcaaaatctttatcgatcacggcttctcgcccttctaatccagtagctgtttctacaacaggaatcccgccaccgccgacagacaccgtgataactccttgttcgactagcgtttcgatgacacgtgcttctttgatcgagattggtttaggggaagcgactacttttctccatccacgtccagcgtcttctttgaatgtcacagtagaatcagcattcatttgttctttcgcttcttcttccgtgtagaatgggccgactggtttacttggatttttgaaggaaggatcgttttcatccacaatgacttgagtgactaaagaaactacatctttatcgattcctttttccttcagtacttcacccatcgcgttttggagccagtagccgattgacccttctgtcattgcgacacatgtatctaaaggcattgctggtgttttctcagaatcagcagcttgctgctgaatcaataggttgccgacttgcggaccatttccgtgagagatgattagttcatctccttgctcgataaatttcactaaatactttgctgtttccattaacgcttcttgttgggcttttgcacttgcatccgtagacaagatggcattgcctcctaaagcgacaactacttttcgtttggccatttcattcgtcctttcttcagttcttctgaattttctagataacaaaacgagccagcgtcttgtgattttccctcaatgctgactcgttttttcgtgagatgaatgtggttatgcttaaacgcgagggataaacaagttacctaatgttgccgccatgattgctttgattgaatgcatacgattttctgcttggtcaaattgacgagcatatttgctgcggaagacttcgtctgttacttccatttcagtgatgccaaagcgttctttcatttgttcaccgtaaacagtgtttgtatcatggaaagctggtaagcagtgcaagaagatcaaacgatctgtattgtgtgttttttctaccatttccatattgatttggtaaggtttcaacaatttgatccgttcttcaaatttatcttcttcacccattgatacccatacatcagaataaagaacgtctgctccgtctacacctttatcaacatcgtcggtaatcatcaattgtgcccctgatttttcagcaaaaccttctgccattttgacgatttcttcttcaggttgtaattcttttggtgcaacgatacgcatgtttgctcccaaaattgcacctgttactaataaagagttagccatattgtttcgaccatccccacagtatgcaacagtgatgccttctacagttccaaagttttcttggatagttaaaaagtcagcgatcatttgcgttggatgccattcgtcagtcaatccattccaaactggaacaccagagaattctgctagttcctctaccattttttgactgaatccacggaattcgattccgtcaaacatacgacctaacactttagctgtatcttctgttgattcttttttacctaattggatgtcattcgcacctaggtattcaggatgtgcacctagatcgattgctgcagtggtaaatgcagaacgagtacgtgtagatgttttttcaaataaaagtgcgatattttttccttctagatagtgatgtgggatcccacgctttttcaagtctttcaagtgttctgaaaaatcgatcaaatattgtaactcttcttttgtaaaatctttttctgctaataaacttcttccttggaatactgattctttcatattaaacattctcctttagattgtttttatttaagattaaagaggaaatcctgacgacagctgacagtaagactgtcgtcaggttataaactacttcaagtcttcacggacaagtggttgactcatgcaacgtggaccgccacgacctcgtgacaattcacttgaattgatttccaacactttgataccatagctacgaagcaattcgttcgatacgtaattccgattgtaagtgactacgacacctggagcgattgccaatgtattggatccgtcattccattgttctctaggggcaacgatctcatccccattaccagttggaatcaatacaagatcatctaatccaagagcagctttcatcgtttcgtgtaagttatctgaatgagtgatcttgatatcatcaccatctggttcgatcgtaaagacatccatcttaccgtctttactttggattgctggatggatagtgaatttgtcatggtctaccattgtgaatacggtgtccaaatgcatcattgcacggttgttcgggattttgattgctaatactttttcaaatcctgaattttttgcgaatagatggcgtgctagtttttctaaagcttttgcatttgttcgttgagaaatcccaactgctactactttgtcgcttaagattaattcatctccaccttcgatatgatcaggattttcacgatccaaccatacttcgatccctttattggcaaatcttggatgatgtttcaaaatatattctgtaaacatcgattcacgacgacgtgcttcaaaagtcatcttattgacggtcattccatttcccattgatgcggaagggtcgcgtgtaaagtacaagtttggcattgggtccatgtaaaatggatagtcgtcgtctgctgaaagatcatataggctgctagaacgtacttcgatatcttttgtacgaaccccagccatgattttatctaccatttcttgtgtttccattgatagaaggaactcatgaagaccatctcttactgcattcgatgcgatatgagattcatccaacattttattcaagaattgttctttgacgttgcctgcgtcaatcgcttctgctgctaatttttccaagtaaagagtttcgacgccttcgttttgcaaggtctttgcaaagttgtcatgctcttcttgagcaatcggaagatatggaatatcatcgaacaacagacgatccataatatctggtgtcaaattttccacttcttgtccaggccgtttcagtaaaactgtctttaatttccctatttcagagaaaacgtgaataggtttatccatgttgtgttgcctccttctttttgattacatgtataggatagcctccttttgtaatcactttcataattttgtctcattcaaaatgagacatccctcacattaatattcgataattaaataattaaacgtttttctaattttaagcgtaatttattcattttttattctgtatacacttccaaaaaaatatttattcatctaaaaaatttttttgaataaatcaaaaaaataaactatactaacattgttagcgtttgctatatgtattattattgttttttatacacaaatacttatcttcaaaataaattattcaatgtagatgtatatttttttacataataacaaattttatttgtaaagtattaaaacttatgtttaatccagatgtgttaaaactttacaaattctttaaaaaaagtaacaataactatattgaacaataaggagaggactttttaatgcgtgttaataaaatcgattttcacttttcaaaactcagatatcaacctgattttgaacatttctcggatgaagagttccaacagatcaaggaacatactgttcttcgttcctataagaaaggacaaatcctttttgatgatggagatcctagacaacggttatatatcttgaccaaaggacttgttcgtttagaacgttacgatgaaagtgccacctattattattatgattacgtgactaccaataacctttttcctatgtcaggaatgtttggagaagagacctacacttatacagctcaagcgatgactgatatcgaaactttctatcttcctgtttcctactatgaaaaattagcacgaaaaaatcctgaacaactgatctatatgatccaaaaaatttctaaagtagtcgaaatacatgagttacgtatccaaattggattaacctccagtgcttttgatcgagtgaaacaaaatctattcattttgaaagaagaacttggcgtaccaacagaagacggccatatcaccattccttatccaattaccttaaaagaattagcagtgaatagcggtacgacacgtgaaactgctggacaagtaatcaaacaactacgtgattcaggactgttagattatcacaaaaagcattttactttctgtaagaccgctactactccagctttgagagaataacgcgacaaaaagaaacagcgatcctgatatttatcgggggcgctgtttctttttgtttcgtctattcaaatgattggtaataataagtgagatcactctctttttttgttccattgtaaactacacctaatatatttgcttttgcaatctgcaacagttctttcgcttttaacaactcttgtttctttgtctttctttctctgacaacaagtagcgttccatccgtttttgctgcaaggatttgagcatccgttacagtcgctaccggaggcatatcaaagatgaccagatcaaagtcaagtatcagttcttctattatctcttccattcttttcgtccctaaaacttccgaagggttgggcggctttggaccactgggcaagatccaaagattttctatatgtgtttcagttatgtaatcgtccgctatccgttcacgctcactaagtaaattactcaatccttcattatgcggcaattgaaaagacaatgctacagttggtttcctcaaatcggcatctacaagtaagacctgttttccactatttgcaaaaactactgctagattagcggcagtaatagatttcccttcatctgggccggaagaagtgatgaccaatgtattcaattcccgatcaatcgctgcaaactggatattggaccggatcgttcgatatttctcggcagtaatcgattgatcagctagtgcaactaaaggaaccggagaggcagctattttctttttcttcatattctctctactttcttttttcattttgtattcagactttctatgtacacgaataaatcctatgatttattgaattaatcatagcacagaaaaaaacgaacacaatttatataataactattttttattacagatatcagcataaaatgtttttaaaacaagctgtctcgtaattttaaataacacaaccaattaaaaataggccaaaaataggcttgtgacaaaaatctgtcacaacccttattacaataaatagtgttcaaaagcttgcatctacggtaataagttcaaccaaatcaaaaacatgtgaagctgtttttttctttgctgttcttataacttgatgcagggcagctttttcacactctctttcatttattcagataaaaccaagcttggatcagcattcaactgatagctggcaaaatttcttttttgcatttccacatgtgctgctgctccaatcattgcagcattatctccacaaagtctcagaggcggaatcactaattctacttcagggagtttagctgacagagcagcttgcaatccttcacgcaacccttgattggccgccacacctccagctacaaccagttgcttgactggataattttgacaagctcgaagtgttttagtaatcaatacatcgatcacacttgcttgaaagctagctgctaaatcatttttgtctagatcttctccacgctgttgtgcattatgcaccaaattgataaatgcactttttaatccactgaaactgaaatcataattatcttcatggatcatcgctcgtggaaaatgataattatcttttccttgatgagctagctgatcgatttcttttccgcttggataagaaagacctaagactcttccaactttgtcataagcttctcctgctgcatcgtctcttgtctccccaatgatttcatatgatccatcttcttgcatatagactaattctgtatgtcctccgctaacaagaagtgccatcaatggaaactggaatggtttgaccagacgtgcggcataaatatgacctgccatatggttcacaggaatcagcggcaattggtgtgcccaagcaaaagccttagcagcagaaataccaatcaacaaagagccgacgagtccaggcccataagtgacagcgactgccgataaatcttctgccgatacaccagcttctaccagtgcatcttccaagcataaggttatttgttctacatgatggcggctagctacttcaggcaccactccgccaaaacgtttatgactgtttatttgggaagcaacgatgttagataagatctctgttccatttctaacgaccgctacactcgtttcatcacaacttgattcaattgccagaatcaattcttcattcatttcatcgtctccgtttttaactttctgctcataatgatcgcatcttctgtcggattgcgataatatgatttccgtttacctaatatacggaacttttctgattcataaagttttcttgctgcttcattagacagacgtacttctaaaaaaacatgcagcgaatcttttatttgttccgcaatcagcagatgtagcaaatgccgtgcatagccttttccttgttctgaaactgcaacagcgatattcgtgatttcgacttcatccattactttcgaatacccgacaaaaccacagatctgattatcttcaactaaaagaagataatctgtgtggggctgttggatatctgtcaaaaactgcatcttcgtccaaggtgagccatatggataagcattttcgctaattgcccatacgcattctgccaaatatgcttcatcaaaatctttttttctgcaaatcaactaatctcactcattttctaaaatttttatcatatctaacgcatcttcttttgtttcagtgtaatatctttttttgatcgtcgttgcttgaaaccctaatttccgataaagtctttgcgcatcctgattactcatgcgtacttccaatgacatcgtctcacagcgattcattatagcaaagttctcgatttcgtcaataagcagcgaaccgattcgtttacgctgatatgccggtcgaacagcaatattcgtgatatgacaatctaaaccgaacgcccttgaaccgacaaacccgatcattcttccattatcaaagatccctaaatatagatgaggaagtggtgacttcaattctgacataaaggcacttttggtccatggcaattcgccattatagacttctcgttcgacatccaacagctctttgatatcttctgtagtcaattctcttagtatatagcgacgatcgatttgttcgattgttttttctgcatagatcattttatcttgaaaaaggcttctagcatatgctttaaattttttcaacatagctttcgtctccaggtgtgtgcgtctctaaccatttctcttcagcttctactcgttttaaataacgagggagaaaagcttgtttatctgcaactggttcatccaacgcacctaattgagccacagtcacaccacttgggatatcccatgctggaactgtattaatcatcgcatcaggtagcatttcttttatttcagagatgaatttatgacaatcactcccaacgaaataaatagcttcattcagctcttgtagttgtgcaaacaaatcagaagcagcaatatgtacatcttcaagtacagtttctaatctattttctttccagcggtatgccccagcatagacattttttcttcgagcatcaaacatgggcacaatcattttattcaccccgacacaattagccgcgatggctttcaggctagatactcctattagatctttatctagtgtataagcaatcgtttttgctgtcgttacacctatacgaagtcctgtataagaaccaggaccatcagaaaccgcgatttggtcaatgtcttggggactcatttgaagatctgcaaacaattggtcaatggcaggcatcagcgtcacactgtggttgcgtttgatatttgtctgtatttgcccaagaatttgtttatcttccaccacaccgatcgccaaagtttgatttgcagtatctattcctaatgtaatcatatatttgatcctttctgctataacattctcgccttccattgtagcatacttttttattccaatgatgaaaatatcaaaggcaaaactagtacaatgatacatgattatctgctgaccggcaaatctagtttcttccttacatacacaaaaaaagttgcggtatcacgacactttaccacaactttttctttttttatttcgtcgactctcgaacaatcaactctgtttccacaatgatttttcttgaaactggtgctttggaattacttagttgaaggatcgtctccactgctagctctcccatccattccgtataaactttcacagtagaaagagagggtgtcacatatttcgctacactgacatcgttgaaacccatcacggaaatatcttctggcaccgctaaacctgtttcttgaatcgctttcagcgcgccaatcgctaaggcatcattagccgcaaaaagtgcgtcaggaatctgctcgtttgtttttaaatattttttaaccgcttgatagcctgactcgacagaaaaatttgcttcgataattgaaccttcgtcgtagcctttttctgctaaaacttgttggaatgccatgattctagggtcccttagtcgctgatggtttttctttgtatattctgttccagcaagcatcgcgatatgttgtgcattctgggaaacaaagtgctcaatgactttttgaacactcgacttaaaatcgacaactatagaatcgattccttgagaagtgccatcagaatctaccagaagcaaggcttgttgggattgtttcaaatccaacagctgagcttcatcgaatttccctaatgcgatcgttccatctgctggaagctcactaatggaatcccacgtttctttcaacaaagtaacgtttgcttcttctgcctttttttcgattcctaaacgaatagacaaataataaagatcttcaagttcttctgtatcatcgtaccattggatcagacgaagggtttgcttagcatttgctgcatttttgcggtgcttcgtataattcaagcgttccgctgcttcaaaaattttttgctttgtggctaagccgacggaaagttcaggatcgtagttgagcactcttgaaacagtagcaggagaaactcctgccaactgagcaatgtctttaattgttgccatttgtctctcctccttttttccgtttataaaatcgcagtaaaccgctcaaacgctgcttgtcctttttcatctcgcttgaacaccccagcatcttccaagacacgagcaaaaacctggcctacagctttttgtacaacatcagtgaccgcgtctttcgtcaaatcaggatgctcttttttcaactgttctgcccatggacgatgatattcagccatctggttttcttctcccaataagaaccgctctacttctgctagttccggtttcaaacgaggtggtaaaacagcaagtcccattacttcgatcaatccaatgttctctttcttgatatgttggacatctttatgcggatgaaaaataccatcaggatgctcatctgaaacattattgtctcgaaggacaagatccagctcaaagtaattgtcccttcttcgtgcaattggcgtaatcgtgtggtgtggtgtaccatctgctgaaaaagcccggatttctacagtttcatccgaatatcctttccacttttccaacactgaattagctgcttcaatcagcaactctttatctgttgattgcaaacggatcacagacatcggccatttcacaactcctgcgatgacttgcggataatctgctaatttgatgagtttttctatcggtgcttttgccataggaaattcatgacgtcctgcctgataatgatcatgagaaagaatcgatcctccaacaatcggcaagtcagcatttgaaccaacaaagtaatgaggcaagacttcagtaatccgaagcagtctaacaaatgtttcctttgaaattttcattggacggtgctgctctgataaaatgatcgaatgctcattgtaataagcataaggagaatattggaatccccagctttcaccatctagattcattcgaatgattcgatgattggtgcgggctggataattcaagcgtcctctatatccttcattttccatacacaacatgcatgtaggataatctactttggctgcctcgcgttctgccgcaatttgttttggatctttttctggtttagataaattgatcgtgatttccaattcaccatatgctgactctgctggaaatttgatatttttagcgatggctcttgttttgatgtaatcatttttcttacttaaatcaaagaaataatcagttgcttcctctggacttttcgaataatgctgtgcaaagaatgcattgacaacggaaggcggtggtgtaagaaaatccatcaattgtgcttcaaaaatctcttgttctgctggtaattctgaaagaacaccattttctcttgccttagcgacaagctgatccaataagtctactgattcttccttaactggtcttacttcgacgctttctagagcgtcttctcctaccatccctaaaagacgattctgtaaatataagcggtccatttccatccatccgccagcttcgatcgcaagtgtggcaaaatcacaaatcgtttgactgattgacatatctcattcccctattcttcataaccatttggatggctgacatgccaatcccatgctgttttgataatttctttgatatctgtgtattcaggtttccagcccagaatctctctcgctttttcacttgaagcgactaatcggctaggatctccagctcttcttggtgctatttctgccgggatttctttccctgtcacttctctcgctgcttctaacatttccttgaccgaataccctttattactgcctaaattgaagaagttgctttcgtttccttctttcaagtattccaaagctaaaatatgtgcggcaatcaagtcttctacttgaacataatctctaatacatgttccgtctggtgtatcgtaatcgtctccataaacagccaatgcttttctttgaccaagagctacttgtaaaatgattgggacaagatgcgtttctggtgtatgatcttctccgatagatgcatctgcttttgctccggctacattgaagtagcgcaaagcgacatagcgcatgccatacgcttgatcacaccacttcatcattttttccatcatcaatttgctttcaccatacggatttttaggattagttggtgtattttccgtgattggagactctttcggctctccataagttgctgcagtagaagagaatacgattttattgacgttgaactcgtgcatgacttcaagtaagatttgcataccgtatacgttgttgttgaaatacatcaatggtttttcgacagattctcctactaaagagcttgcagcaaaatggattactccttcaatcggttccttttcaaatacggaacgtagaaattctttatcccgaatatctccttcataaaaatgagcatctggatgtactgcttgtttgtgacctgtgagtaaattatctaccacagcgacttgataccccttttgaactagctggtctacagcgtgcgaaccgatatagccggctccgcctagtactaaaattgtcataaaaaacactcctttgattagtgaaattgtgtttgttgattctatataatttaaaaaacgaagtctactttatggtagaaaagaagaaagtaaaatttcgtaaatttatctggtaaatttataataaaacatttagtaaacattttcaaggattttttgcaaaggtttacaaacaaacgtaaaactagcctttttttctcttttgttccataatagatataacaaataataaatgaggtggattcaatgaaaaaatttgtatctggaatattagtaggtagcttggcaacagccgctgccgttgctggtttggtcgcttctgtgaaaaaaacagtgatcgatccgattgacgaaaaagaagcaatgatcgaagaaaatcgtaaaaaagcaatgcgcaaacgcgtttctcgttaataattatttaaaaaatacgcatgaagacttgtgaaagaacagataagtcatcatgcgtatttttatttgtcagtcaatataagttgtgctattttatctgcttgtctcaaattccatggatctgtataaggtctagctgctgctgcagttaaccaatccacaccttcaactggtattccatagcaataaaagccagactggattttcccggaagcatcaatcacgcgattcgtacctcgctcaacatctatagcttctgaatgataacttcctgtattatctgaaaacgaaaaagggcgaacaagtttattttccttcaaattttttatgacaggattacttgaatgagaaaagcttgtttgtggcaaacgagcttcgatcaaatagagactgctgatttctttatcttgtagagaaataacataacggttttgcttttgctgaatatcaagtggcggttcgatcaaatgaaaaatacctgcatctatcagtgctgctaactctttcgtccgaataactggcggaccaatcgttaaaaagctgtttagatgagtaaaccacccccacagtatttctttgtattccttagcagaaaaaacgtgccattcaatagcctgccggattggatcacgccagtctttcaatgcatcaaatgtcgaagtcaatgcccctgtgcaattgcctttttccgcttcttttatctgcccttcaataaatgctcggctagcttctgcaaaggactcatcctgataggtaagaggagtttctagccacgaccaagaccatttgtaaggaagtaatgctggatactttccaagacactcttctgaagagagggaaagaaaatcatgctcaaaagttttccttgaaatcggcaagtgatgttcttcgatgattttcttgtaataaaacaactcagcgtcttttttcagatagtcaaaaaatgtttcgccagtcaaaagtcccgatcgatgccattgctcaaggttctcttttgtaagtagccgtggccatgccattgctccgccttgcttttgatttctccctcgaggatagtaaggcagacctcttcttgacccgctgtatacaatcggttccttgccagatggatgatagaccagttttccctttttgttttcgaagtgccctcctcttgataccgtaaacaatccgacataatcgaaaaagcttaaaccaagccctcttagaaagacattttcttttggcggtatctttgaaagatcgacatctgcaggattagaaggaagctgatacagtaaatcatttttctttgcatagtctacccaggctctttcctcctctgtctgatcattttcccaatgaccactcgctaaaatgagctgatcgacaggatagctttggtgatctgtctgtaataggaaaccgtctttttctttgctgacctttttcactaaagaatagacaagctgagtagaagctggaaattcttcttgcaactttgagaaaaaccagcgttgataaagcccgtataggcaacgagtagattgctgatctttttctagacggttaatttcttctataaatagttgcttatttttggttaccgtctgttcgatataatctgtagcaggtcctttactccattgaaacaaattaggtcccggcattaccgttcccccactggacaacgtctcgtctgtaaaaagcgtcacttgttgagaaacagagttcattaataattctggcggctgattcaaccgccaaactcgaccgcctggaccttctggatcaaaaagaataagttcaagagaatgtctgccctgattattatacagaatcctttctgctacacttaatcctctaggtccggcaccaatgatccctattttcatttgtacacctccttttcgataaattcttttaacacaacggcatggttctggtgctcgttttttgcaccataaacgaaagtaatgactggatgttctttcataagttggatgagttcggaaacagctcgcgtcttttcttcttcaaaagacaattcttgctgatatttctttgcaaataaagcaaaacgttctggtacgtggtcaaaagctttgcgtgcttcattactaggcgcaatttctttcaaccatagatctaagtgtgctttttcttttgaaatccctcgtggccagagcctatccacgagtatccgaaagccatcctcttcttcagcatcaaggtaaacacgctttaatttgatcatagttgtttccttctttctgccttttttcttttatattttatatgtagataatagcacaaaataaaaaatgaacgacacaactatccctcgcgtcgttcattttttcttagtcaatacctgattattgatctagtttttccaaagctgtcataaaaatatatgctttatacttttttgcttttgatttttccagaccagccgtcataaccacccttaagcaaataaatctctttataacctgctttacgtaatttatttgccgtacggatactcaagcttttcttttgatcgtagatatagacaggttggtcttttcgaatcgatcctagtgaatctttcaaaacagtgtaagggatgtttcttgcacctaagatatgccctgcatcaaacacatctttttcgcgaacatcgattacttgtgcttttctcattccttctcgaaactcttcttctgtcaaagtcgttgctgaacgcttggccattactcgtagatagacttcccaaaagatgattgcaagcacaatcaatagcaaaatgatattaattacccataaaaccatgtaatgcctccgtttttttaagcaaatttcaaggctaatgaggcagcgccaatgacaccagcttcatttccaagctctgctaatttgatttttgttgattctcttacttgcgggaaagtgaattctttaaaatatttctctacacggctgcgtaaaaattctcctgccgccgatactccgccgcctaacacaatacttgacggattcaatgtattccccaagtttgcgcaagctaagcctaaatagaagcatacgcgatcaacaaccatcaatgcaaacggatcgtcttcttgagccatttcaaagatatctttacttgttacttcttcaccgttatctaacattgctttcagttttgaatctcctgcgtattcttctgccaggtaacgtcctagacgtaccacaccagtagcgctagatacagtttctaaacatccgcgtttaccgcaagtacattcgaacccttcaggatccacagtgatatggccgatctctccgcctgctccgctcacgccatggatcaaattcccgccagcaacgataccaccgccaacacctgttcctagagtaacgaatacaacgtctggatcgttttctccagcacctttccatcgttcacctaaagcagccacattcgcatcattatcgatagcgaatttgattcctgtccctgcttcaatcagttttttcacaaattgtacttctgtccagttcaagttatatgcaccaataactgttccagcgtcactgtccacgcttcctggagtacccataccgattccaataaagtcttcggctttcatattatataaattcaatcgatggttgattgattcgatgatttcaggaacgatatgtttgccatcatccaaaatattggtatcgatgctccatttttgttgaatctctccttctggtgttaaaattgcaaattttgctgttgttccacctaaatcaatcccaataattttcttgtccattacaaatttcctttctttcggctttcttcaattcggtgctctctttttaatatgcgccacgctgtcatgtatgtatcatgatcgatcaaacggctatcatacagattccgcaattcaatagtcatcaattcaatatcatagatgcgtgcacccacatagataaagatgccaaattttttgaacagctgctgtacatcatataagctctccatctttaagcacttccttcatattatacaagtaaaccatatttttttaaacccagtaaaatacatattacaaaaagaaatacaaaaactagtgtagaaagaatcttctggtgtatcgaatagcttgtctgctgtttcggtagccctaaaatgttccctaatactaaaccgcccaccagtccgccgagatgtccccaaacatctacagaggtgtcaagaagaccaaaaacaaatgtcatcgcaataaataaaagaaaatgtctgactagttgttggatcgccgtattatatttaaaatgaaatcctaaaataaacaacgcaccaaacaatccgaatatcgaagtgcttgcaccaccagacaaaacattcgcttcgttgaaagcaaaacttgctgtatttcccattatcccgctgaacatatagatcaggaaaaaacgccagtgaccgtatattgcctcgatttgttgccccataaaatacaatatcagtgagttcatgacgaaatgcatcactccaaaatggatgaagattggtgtcactaagcgccaccattcattgaagtgaacaagataaggaccatacattccagtataataaggaatttcaagacgcggaaacaactccattataatgaagactattgtctgtatccccaaaaaagcataggtccataacggtcgcctcaaccatgcacgcatttttatttgctgttgataattcatgaaaacctcccatttcattttagtcaataaataattgttggatcttctgatcaaaactttccggttgccattgttcattcaattgttctcgaaaaacgaggctgcatgtttttcgatggaaattttttaaataccggtcgtaataaccaccgccaaaaccaattcgataaccggctctattgtagataatccctggtacaatgaggaggtcgatcatttccggcaaataaagcttctctgattgtggctcgagaacgccaaaactcgaacgttcaaaaacggtgtgttcatccatttcataaaacgccatctgacgttttggtaaagttttaggaacaactatcttcttttgttcttttttcgcccgttggataatccgctgtgtatccagctcaaattcatttgacaaagtcgtccctatcacttgtgccgacttccagtactcgcttgcgaatagctgttcatagattcgctgttctttgtcctttttcttaccgcttttggccagatttttcagcttttcgattccttgtcggcgtaatttttctttcatttgctccaaaaaatcaccctttcttctctcataaaatggtataggaaaaaaagaaaaatagcaatcgaactttcaaataaatgtataaataaaagaaaaagaagacctaacaatgatcggccttcttgccttttaatgaacttcaaccgctcagcacgtgtttttgtctgataaacaatacatacagaaaatatggcgcaccaaaaaaggcaatcaaaatccctgtcggtatttccccacttggcagaatcactcgtgcaacaatatctgcactaagtacaaaaacggaaccaaacaaactgcttagaataaaggtccagtgattttctttacgtacgactagcttcgcagcatgaggagccagtagtcctacaaaggataaactccctgtcaccgctacgctaccgcttgctaaagcaacagctaacaacaaaaggattttttgacttttagccacatttagccctaatccttgcgcgcgttcttgaccaaatgatagcaagccaatccgctgcgcataaaatcctcctagcggaatcaagataatcgcccatggaagaagcgcccaaacataggaccagctcgcaccccaaatcgatcccgccaaccatgcattgacaaatccataattttcctttgacaattggatggtgcacaacaacgttaatgcagaaagacccgcattaacggcaataccagacaataaaatacgattcatccctaaaaatccatttcgatcataggccgcaagatagacacagcaagcagcgagaataccacctataaaggctacgactagcaacagaaacggcagagaatattgtgaaaagaaacctaaataaagcatcactagaaatccagctcccgcattgatccccaatatgctagaatctgccaattcatttctcgtcactccttgcaagacataaccagagacgccaagacaagcacctgctaataaactgatcagtaatcgaggaacacgaaactctccaacaatcagcgccaaagaagaggagcctttccctatgaacgtgtcaaaaagctgatcaagataaataaaaggcgtgccaatcatcaaactacctacagacaagacgataagtagaaaaagcaagaaatacaacgtccaatatattcttttcaccgttgttccctccttacttgtatcagtaaaaacggaacgccaatcaatgcgatgactaatccaaaaggtgtttcaaaaggtggattgatcatccttgctgcaaaatccgccaacatgaccagtccgcctccaactaaaaaagagacaggtaggacataacgatagtctgtcccaaccattccgcgaacaatcggcggaaccaacagcccaataaatgaaacaggtccgactaacgaaacggcaatggctgctaacactgcaactagacagaaaacaatcaaccgtgttcgtttaggatgacctccaagagctaatgcatgggtttcactcaaactaatcaaggatatcgcttttcctaatgaaaaagaaaccaagacagcaagcacatatacagggaacaacactgttaattgtttccatgtgatattggcagctccacctacaaaccaaaaagcaagatcctgctgtagattaaaaaattgggtaagtgcttgactgattgcagtaaaaaaagaactaatagctacaccagctaaaatcagctgtaaaggattcatgcccattttcgaaaactgcaaaaagccaaatacgagtaaagtcacagcaaaagaacctgccaatgacaccagaaacacagaaaagccagaagctttgggccaaaaagcaaaactaagagccattgccaacgaagcaccagcgttgattcctagtaaacctgaatctgctaaaggatttcttgtcactccttgcatcaatgcaccgctcaatgcaaaacaactccctacgagaaatgcccctgcaacccgaggcaaacgaatgtttcttatgatttgatgactttgttttgatccatcaaaatcaaccaacgcctgccaaaaggctatttttcccacactcgctgcgccatttgaaagagcaataaaaaaaatgatcaaaagaacaaaacagatcaaaagcaagagtttgttttttttcctagccttcatagttgatcctcctgctcttttggcaacagatcatacgtcagaaaaactggtttattcgtttttggtagtgtgacgatcgttgcatcaatctcaaatatttttttcatacactcttttgtgatcacttcttcaggtgtaccttccgtgatcaattcaccgtttttcattcctagtaaataatcagaaaaacgtgaagcaagattaatgtcatggatcgacatcaagatcgttgtttgttttatttgattgatttgagtcaataactgtaggatctctaattggtgtgacggatctaaaaacgtcgtcggctcgtctaagatcaagatatcggtttcctgagcaagtgccatagcgatccagacacgctgggtttgtccaccagacaacgttgcgatatctcgcgtgcgatatccagacaaacctgttgcatccaaagcccactcgattgcttcatgatcttgtacatccataccgctaaacagtttttgatagggatatcgtccgtaagatactacttcttctactgtcatacctataggatgttcactagtttgtgctaataaagcaattttttttgcaagttcttttgaactgtatgtagatatatcagaatcattgacaatgatctttcctgatttcacaggtattatgcgggtaaagcttttcaataaagtagattttccacttccgtttggtccaatcaagctcgtgattttcccttcaggaatcgtaacagacatgttttcaataatttttttattttcgtagccggctgcaatatcagctgcccttagtctcgtcatttcacccatcctttcgctgaaaatcattctcaattatgacgctgtttcactatttcgtcaagcgctactttcatatctatagctaaatgaagcggttgacagcattcgaaatatcaggaataataaccaatgagaaagattctcaattatgtcaggaggaaagaaatgaacttaaaaacaaaagtattcacattatctagcatattgctgttggctggagtattgagcgcttgctccccctcttcagataaagaaacagctacacctaccaattcgacgacttcatccaccagcacgcatacagtcacagatacgcttggacataaagtcgacattccaaacgcacctaaacggatcatcggcagttacttagaagactatctgatttccctaggagaaacacctatcgtccaatggacagtgggcagtggttctatccaagattatctgcaagatgatttgaaagatgttccaactatttcttatgatcttccttatgagaaagtattaagcttcgaacctgacttgctgttgatttcttcttccgctactgtcgaaggtgggaaatacgagcaatatagtaaaatcgcgccaacttatgtcgtaaaaaacggaacagacgtcacatgggaagaacaactaaaagatgtcggcaaggctttagcaaaagaaaaagaagcagaaaaagtcatttccgattatcaaaaatccgtcaagagcactcgcgaagaattagcagataaaattgagaacaagacaactgcagtgttatgggtgaccaataactccgccttcatggtcagcaaaaatcggtcaagcggtagaatcgtatatgacgatctaaaatttggtgtgcctgatttagtagaagaagtgtccaaagaagccacttctgactggtctgctgtttcttcggaaaaactagctgaattagatgctgattacatcattcttgtaaacagtgataaagatgccgctatgttcaatgaaccaagctggaaaaatctcaaagcagtgaaggacgatcacgtactgcaattcggccctgaatctagctggctatataacggacctattgccagtcaggaaatagtcaatgatatcaaagaaaagctaaactgattttaactaaaaaagcatcttcacgttcattcgtgagatgcttttttattattaaaaactgaataccagatattattcttcttttgaaacaaccctattttttactctttcccatttttgaaaacgatgggcatataaattttcctgatccgttattccctcgtattcctctataagagtgaactctgaaaaatcgatatccccaatatacgtatctccttcaaacgtgctatcaatcaatgtccgccagattcgaccggtgtaaggaagaagttcttgaaaaatccgactgccacccgaaacatagatatcttctgagattgtttgactatacgccaaaagttcatcgattgaatgcatcacttctgcattttctttcgtgcgaaagttcggttgcgttgtcaacacgatgatatggcgataaggaagtgagagatcgcccattccttcataggtctttcttcccatcactaagattcgatccattgtatgttcacgaaaaaaacgcatgtcatttggcaatcgccacggtagcaatccatttttgccgatcagaccatttctatcttgtgcccacattgaaataaacatatcatccgctccttatgattttagatggtttgagataaaaaaagtctcaattctttgaccagcaaggaattgagaactttaaaaacattattttgtttcacggtgcaaagtaactttgcgttcgcgtgggcaatatttttgtttttccaaacgatcaggattgttacgtttgtttttgcttgttaggtagttacgttctttacaagaagtacactctaaagtgatgtttacgcgcatgtttttccctcccatttttacaagaatcctctaagatgactctcagacttgattatcttaccatgattttttctagattgctagtgtttttcacgattttgttaagtaaaactacttgacgataaatacaacggttttacttctcaaacaaaatctttttctttttgtataaatacccttacacttgtttatatagattatgttttttaataaagggggatattaatatgccatggaacatgaaggactttcctgcatcaatgaaaaacttagataaactgacaagaaaaaaagcaatcgacatcgcaaatgcactgttggatgaagggtaccctgatagccgtgcgatcccaattgccattgatcaagcaaaaaaatgggatgaagatgctagtgaatcagaaaaacgaaccttcgaaaaagaaaaaaatccaagcaagacggatgaacacgatacgaatcctcgtgccggaaaactgcttgattcagatgtgatcgtagaatatgaggaagaacaatggatcgtgaaatctaaaggggcaaaaaaggcaagcaaccattttgatacaaaaaaagaagcaatcgaaaaaggaaagcaagtagctcaaaacaaacaatcaactttgatcatctataaaaaagatgggacaaaagaaaaagaaatcagttactaagcgcttaaaaagaagcatagagacaaggagatcatctcacatgtttctatgcttcttctcatattgttgtttcttttttatcaaacagtcacatagtcgattgcttctgcttgcggaatcgtttcatcgacaaagtaaactttataccatgtcaagaaactgaagatcgtccagattttacgttgttcttctttacgtccttcgtgatggtcatctagcaacttcatgattttttcttgatcaaaaaattcttttgcaaaatctgcttcgaataatgctttgacttgttcgtagccgtgttcttctttcaaccaagctttgattggcacagggaatcctaatttcacccgattcgaccactcttctggaagatgtttgttcgcagcttgtctgaaaatatcttttgtgttgttttgattcaacaagaacttacttggtatttgttgagccaatttcatgacttcgatatccagtaaaggtactcggacttctagagaactagccatagaaagtttatctgccttcaacaaaatatcttttggcatccattgatgaagatcgacgtattgcatcttattgacttcatctttgattccttctgttttctcgtaatgaacagtcatgatctcattcacagacggcgctgtttgatattttggcgtcaacacttctgatgcttctgattcttcgaacactcgagcatgcccgataaaatattcttttgctggcgcaagtgattcatataaatggatacgtccatggaaatttttcatttttccgattttacgtcctagattatagcgtgtcccttttggcaattttttcagtccttgcgcaatcacacggataaattttgaattcgtgtggaatccatacgtttggtatcccgcaaatagttcatctgccccttctcctgattgaaccacccgtacactttgtgaagcgagatttgctaaaaagtacaacggcacgcaagaaggatttgagtctggttcatctaagtgatactgaatcaatgggaatgctttaaaagacatgtctccgtcgatcactgctgccgtattgtctaagtccaataattctgttagttttctggcttcaatcgcttcattataggttttatcatcaaacccgattgagaaagaatgatctggtttcaatacagaggttacataactggaatcgaccccgctggataagaaagaaccaacttctacatcgctgattgtgtgtgcttcaatagaagcttgaacagtttcgtcgattttttcgagccattcttgtcgggaatgcgtttcttttgtttcaaaatctgcatcccaatattgttgaatgtccagttttccgtctttatacgtataataatggccttcaggcaaacgatagacacctttgaagaaggtttcaccgttcaatggagaatattggaaagtcatataaggtttcaatgcttctttattcaattctttattaaaatcaggatgaggcaaaaaacttttgatttctgaaccaaacataaatgttccgttcatttctgcataatagtatggtttgatcccaaaatggtctctcgcaccgaataactcatttttttcattatcccaaatagcaaaagcaaacattccgcggattttttgcaataattctgttccccattcttcgtaaccatgcaaaaggacttctgtatctgcatgtgtttgaaaaacgtgaccagctgcaatcaattcttctctcaaaggctgataattatagatttcgccattaaaaataatgatctttgtccgatcttcattgtaaataggctgagtaccgccctctaagtcaataatacttaatcttctgaatcctaaagcaacgtgtttatcgatatattcccctgaactattaggtccacggtgaacgattcgatccatcattgtattaataattgtttttttgttgtccttgtcgttaacaaaacctacaataccgcacatttaactttcacatcctaatataaaattactgtttatttcatccatatgcatcttaacatagaataaatagcggacgaatattttctctcttacagtttcgtcacgtgaaaacaaaagatgaaagtttctgtttttacagaaaataaagtcccgatatctaatttaccatgttttcttttttgaggctatcttattctcttcgtgttaaaaaaatattagtggatgctgttcaaaaaatagcctccagacaaaaagacacgaccgaaagatcgtgtctaattatgactatataagaaaatatgcagccaaagagagctcttcattcgctcatcgacatagttgaattgaaattatgatttcttggaatgatagtaactacttcattataagaaatctcataatcaaagttccttccaaaagaatggtctttcgttgcataagtgatcgcgatgcacatcgctttccccctaaaccaaatcgtttttacacttttatcttacatctggtatttttatatcaaaagaaaagtccaaggagatttatttcctagcatgtatgaaagatcgtactcagaggaaatcaaaaaatattttgggctaaacatacaacaaaaaagacacgatcgaaatcgtgtctaatcgttgatatataaggaaggtacgggatttgaacccgtgcaccacattactgcggctcgccggatttcgagtccggtgcattaccactctgccaaccttccgtaagtactatttttaaactttttccacgaaatgtcaagcctatttctaacagataaataacagaaaccgtttttttacaaaaaaagtccattgacagtttacagccaacggacttaccggtcaaattcataatgatagaacactatctgattgtttcaggattatctaatgctaaaatcgagtcaattgtccgtttgatcagtgcgatgatttgttcttctgttggatgcatgatgtttgatgacatcaatgatgctaagccagtcaccgctaccaatgtaccagtatgcaaggcatcgatataatcatccgataattgattgtatctttcatcttctttgactatttcacggaaatagttgtaagaaaaatcatgcattttctttccgtccccatgttcatcaatgtacaatgccatgtaaagactatgatgtttctttgcaaagtagatatagttcaaaccgagatcaatgattttatcacccgtgcgctcaatagggaaaacatcttcttttagttgttcaaagattgaatccaataacgtatttttcaaatcttccatgtttttgaattccagataaattggctgagtcgaaatccccatctttttcgcaatgtttctcgcagtaaatcctttaaacccttcctttgcaacaacatcataagcagcttttagaatttgatccttggtatagacttttcttctcattaaaactcccccacttctttactgcagtatatgttgttttattgtaccctatttttagtattttttgcaaacattttactcaaaacgttatattttaaatttttttctcagtcttctttaactttttttgcaaaattaaaaaaatttggttaaattcactgggttcccttacatttttagttttaacctaaatgatagttgaccaaatctttcatttcaagttatagttaaagaaaacgaaaaagaaggtgtgtaatggaaaacgaaactgacgttatttatattcatcctcaaaaaagaatcgtttcacagaaaagaaaatatttttatcttagttttacaggtactttttttctttttattggcttagtttctggtacacctgccgctaattggagtggactactgactattcttacctcgccaagcaatcttctgacagattattttgctttgggtggttttggaagcgcatttataaacgttgggatcttgaccttactttctgtgcttttggcttaccggcaaaaggtgattttaaatggccccttattcgcttcgattttaacagttaccggtttttctttttttggcaaaaacctttataattcgatctcgatcattttaggtgtatacctgtatgctgtatttgtcaataaacctttttctcagtatattatgataggactgttcggcagcgcattgtcgccggtcgttagttacattactttcggtatgcgctttcctttgctagtaggtgttctgctgggcaatttggccggtatagcaattggtcttcttcttccgccattggctgctcaaactttagttttccatcgcgggttcacgctttataatattggatttacctcaggcttgattgccatggcttttactgctgttttgcgattgttcagctactcgattgtcgagaatacattggtttccaatgaataccattcccctctcgtctggatcattttcggcttttttttgctgacagtcggttttggtttctattataattcctttcgactttcgggtattcgagagattttcgattcctctggaaaactgacaactgatttcattgctaattctggtatcggtgctactttgatcaacatggggctagttggtctaatgctttcttcttatgttttgctggttggtggtaagttaaatggacctgtcatcggtgctattttatctgcagttggtttcagtgcttttggttgtcatttgaaaaacagttttccgatactagtcggaatctttcttgcttctttgtttgggacatttcatgaaatcaccagcaccggcatgctcgttgccgctgtgtttgggacaggcctcgcgcccataagcggtttttacggcagtttttacggtgtaatagctggtatgttacatattgctcttgtccataacgtcagcactttgcacgaaggactcaatttatataacagtggtttttcaactggattcgttgcaggcatccttgtaccgatactagataactttaccgctgtcagaaaggaaaaaaagacacttggaaaaagaattatcaaaaagaatcatcgatgagcttcttacttatctatattcccacgaaataactgaaatacgtattggcgtagaatttgctgaggagggacttttcatagaaatacagggcacaacagaaactcagccagaagatctagatgtacttgctgatttgctgaaccatcctcgagaccctagcatggaaatctactatcaggagctattaggtaatcctcgacatgattgggaagattatcatctgctaggtagtttgattgacgatgtggaaatcatgtatgcccagccgattatcaatatcaagattttccggcgtgcttctcctcgcccctattattaacctattttacaaaacagcttcatccacctaaaacagctcctgaaagttcgattaaaaatctacttttaggagctgttctaagcttgatattattgattttccaatcctttgtatagttcatctgttacaggttctaaaaactctgaattaccagcagtgatcgccaaatgttcaaaccaactgtcttttgtcgcaccatgccaatgtttgatccctttgtgcgttacgacgacatctccagccattaatcgtcttgctggctttccttcttcctgataccagccttctcctccggtcacaagtaagatttgatagccgtctgtatggacatgccagtgattgcgacagcctggttcaaaagttacattccctacaccaacagaaacttcgggatcgtttactaacatattcagatagctttgtccggtaaatacttgagcgtatgcttcgttttttttacctgctggaaaaatcacgcctttttgtatttcttcgtgttttgtcatcatttacgcctctttcttatcttctctattttcttctagatagatttcttttgctaaactaaaagccgaccaagcttttggccaccctacataaaaagctaaatgggtaatgatttctgctatttcttcactagtaatgccattttgcttgccaattttcagatgagctggcaattgttcaaaattccctcctgagatcaaagcagatagggtgatgatactacgctgatgaggagataattcttttcttgaccatacttgtccaaataaaacatcgtcattcaattctgcaaattttggtgcaaactcccccaattgatctcttcctgcggtttgtttttctgccatttttttatttcctccgttcgtgattgctaggtgattcgaacattgttcttaattacatcattatctattgtttcttcgcattttattttaagccccattttttaacctgtccaatgcttagtttattccatcagtatgctttccaagcataattgttaacgttttctatcttttttctatttttgaaaaaacaagatattaaataagtctttagttggatgtttttttgagattattcttttatacttataatgaacgtatgatgaacttacaaaattgtttgttttctgtcatcttaaaaagtggcgcagacagttgcttttctagtaaagtatagatatcaaagaacctctaaggagttgatgaataatgaatattgctgcctctcgaaaactgataaatttcatttccattatcggattaggtctatcaatcgcgctgacgatttattttattaatttaggtgttttcaaagatttgaatgctttaagaggattagtaggtgattcgatcattctaggtccggtcatttttatcttcatccaaatcttgcaagtggttattccaattattcctggaggaatcagcactgcagcgggcgtcctgatatttggtccttatgctggctttatttacaactatgttggaatctgtattggttcgattattatctttcttctaggacgacgttacggaaaaccattcattctttccatgatcagcgataagacctataacaaatatattggctggttagacaatcaaaaccgctttgaaaagctgtttgctctagctatttttcttccggttgctccggatgatgcgttatgtttgatggctggattgacaaacatttcagtgaaacgatatacactgattattttgattgctaaaccactatcgattttcttatacagtatggctttgatttatggaggacaatatctaagtggtctgcttggttaatatttattttgcaaaatcagttattgattgattaccaatgttaattctgggaaagggtctgcaagatacattgcgccctttcctttttcattggatttgcgctacaatgtgaaagtaggtgataggatgtattatttgaaacgtagcttaggcaacgcgtgggattttttgaaagggacacaagcttatttccgtgatgtcttgctgatgcatggctttattttatttatttgtttacccttattgagcagtacgactcgttttattttgcaccgaggagcaattgactatttgtcttatgacaatattcctttgattttctctcagcatcctggagttctgctgtcgttaatcgccgttttactgacgattttactattggtttatttcgaatttgcatttcttttgatgagcgtcttttttattaaaaagaaagaaccggtttctttaaagcagctcttgcacttgacgatacttcaactgaaaaaagtgagacctattacttttttgttttttcttgcttattttttattgattctaccgatcagcgggttaagtttcaattctgatttactgtcaaaaataaaaattcctgcttttatcatggattttatttttgctaaccgctggatcgtcgtcagttcctttttactcgtttacatttttcttggctatattgggattcgtttgattttcgctttacctgaaatgattttacgagatcgaccttttcgagcatccatccgagaaagctggttgctgaccaaatcacgtctttttgccatcatggggcaatttatcgtgattggcggtacgattttacttctttcttctttgggatatatcgttgttatcttggcacaaagtgttgttgaagaatttttcccgaattacgcattgatcagcgctgtatttgcgatgacgcttttacaaggaattttattattcaatatcgtgatgtctactgtaggaattttttatatcatcgttgatttcatggatgacgaaggtttcttaccagagattcccaagtggtttacgcctcaaacacccaacgtgcgtttatctgcgctgaaaaacactggtttgaccctttttgcagtttttttcggtattggcgtttgtctttacaatatggattatctgacttcggcagttcagacaaacccagtgactgtatctcacagaggtgtaagtacgcaaaatggggcgcaaaatactttagaagcacttgaaaaaacaagcagagactatcgtcctgattatatagagatggatgtacaggaaacaaaagatggccgtttcgtagtgatgcatgatgcaaatcttcgccacttaacaggggtaaatcaaacaccacaggatttgacattgaaagaattgacaaatcttacggttactgaaaatgggttccaagcccctgtgtgttcttttgattcttatttagaaaaagcgcatgaattgaaccaaaaattacttattgagatcaagacctctaaaaaagattcggatgacctggtcgaacgatttgttcagaaataccgcaaagcgatcttagagaatcatcatattttgcaaagtttgacgtatcaaactgtttctgatttaaaagaagcagaaccaaacttttatgtgggctatatcttgcctttcaatatcgttggaccacccgtaacgcctgctgattttttgacaatggagtatagtacgatcaatcgtaacttcattaattctgcccatcaagatggaaaaaaagtatatgtatggacaatcaacgattcagatgctatgagtcgcatgatgttttatggtgtggatggtatcataaccgatgagatgggactactaaatgaaagtgtgaaacaaacagatgaagaaatcacttattcagacaagctactaaattttgttttgggtgttggctaatcaaaaatagttgatgaaataagcctttatacaacaaaaaacgcataacctgttaccgcaggtatatgcgttttttgtttgatattcataacgtgtccttaactttctcttgattccttcatcgcacgaacaatagataaaatagcaggaattgcagagatcactgcaagaataattcccattttccctgaactttttctttttggcatatcttctcgctcccttctgtctttatttatattataagggagttcttgcgaattctcaaaaatactgtttaagaaaccaattcagcaggtgcactaatatcacagaattttacgagcatgcggtacttgctttcatggatgattggatggtctcgttggtcataactttcaacatacacgacagccgtgttgttatatgtacgttcaatacagccgattagttcgtgagatacgccgatcggtttgcatatataagttcttcctacttccgcttttaccatttcattccctcttttctttgtttttctttattttataataacaaatctccctccatttgaaaacgttttattttgcttttttatttttatttgatttattttttactttttagataactattttcttatcataattctagatgttgtgacaaaaacgtttgtttatattcctatgttgttcgtgtgttcttttcattatcctgctaaattatttacagggggtgagcatatgatctatatccaagcaatagtctttgtaacgttgatggttggactacttattggcttgaaagaaaacagctaattgatttaagaaaaagtaaacaagaaaagtgataaatgctttttaattgcatgaaaaaacggacgatgctaaacttgttataggttcgaaagtttaaaggaaactttcaagaactgaattacattacaaaggagatgaattttatgacgtttacaaaaacaaatatgcaataccgcgtagcctttgatacaacttctaaccgttttatggcgattgatgcacaaaacgaaaataacgttgcgtttggtattacaattgaacaagcagtccgagcattaaatgaatctagataaggagtgacccattccaaatggcgactgatgagatctcggaaaatcaataaaagacgtttgtaacggtgatccgcgacagacgtctttttgtattcattacatatatttggaaattgtatctctttatctctagacctaaacaaaaatacaagttctaatatcaaccatctcgttttttatgacaattttgttagctgtttcgatgataatattccgttattatctgtataatatttaatataataaaaataaaaaaggagatctttcatgaaaaaaattttagggttgatcgttatcatattgattgcttttataggatggaaaggctgggactactatcagtctacttatgtaggaaaagattattatgcagtaatcaaagcaccgatgcctgcagaaactgatattaaagcagataatggagaagtaattggaaaagggtttaaatataacgtagatgcgtacgctgaaaacggtgaaaaaagacaattggattttgatgtcatcacttctggcgactctgctaatggttctgcctatcccgaaggaacaatcttgcagttgaaagcaagcgaaaagcgaattatagagaaaaaagtaatcactagcgataaagtaccttcatctataaaagacaaattagggctatcttaagattaagaaaatatcgcaaaaaagcactcgatttgagtgcttttttgtttgttgattttagaaaacaaaaaaatagaattggtcttcgaagtcactttcctgttcttccagtccttaactaaaaaacaaggcaatgaatcgattcccatacaaacaaggggctgtgacaaaattcttgtcacaaccccctttttccgaataaacggtgttaatatgtgttaagtacctaaatgggtaccagcttttatttcaaagccaacatgtttctatcactgattttttaaatctagcgaaaaacccttatcttacaggcgttcgttcaattctttcgcaaggtcttcaaagcctggtttgcctagaagtgcgaacatgtttttcttgtatcatgtatacatttattactttttttctcttttataccgttagaaaacgccgaaatatcagcattttatctatctcttgttttttctatcttttctgatttttaatatcactatcaccaaagctatcactagtttttctattatttttacttttttatatgtatattgaaacaggagttagaaaaattaatagaagaacgaaaaaagacctcaaccaaatttaattgctggggtctttttataagaagaaatgcatattatcgtttagatattgtcaatacatattcaggaaaatctattttagggtttacaataagaacgtttgttcgtataatctttttgaggtgaactttatatgttaatggaaggaaaaacacaattatggtttaaatttgatccttcgaatagatttatcaaagatttttataaggtgtgggattcagaagttttctttttagcaatcgaagatagcttattaatcaatctcttatttgtcaagaacttttttgaagttttttccgatagaatcaagcttcgcaagctgttcttttttaacgactcagttatcttatcacgtctaaaaacatgtgtcaactcttttttggaattttcacaaaatgtttcaatcagatgcgacaacgttgtttaatatatcattaaaaaaaataaaggtcaagctaaaataatattttagcttgaccttattataatttcaacgattgtcaaaagtattgtttgcaactgtgttccctgtttctattgatagaatacagctttcgaaacataagttttgaactgcttcgatccgtccaaattcttttgcagttattgtacaatgagtaaagcagacatcttctataggtttttcaggaaatgctaccaagtcaaaagcccgagaaggaagtggatagcctggagaaagacttgcctgtacatttttgacatgtatgtttctgacttttgtcatttgttttgattcaggtatttcttcagccactgcttgccaactttctggcattcgttcaagatcattgctattttttctattatattcattatgccagtccattatccaagaaaacggaaattgtacatccatcatattcaggttttctaccctgatattttcaatcactccccctctttctcttgaagatttcattcgaataccacagtctgactgaaaaaaatcgatatcgtgaatatacacatcactaattccagcactaacttcgctaccaatagttacaccgtaacctgaacgaatgttacatctcgcaatctcgattcttgatgattttcgattgactcttgcaccgttaccgtccctgccagatttaatagcgatacaatcatcaccacaggccaaatcacattcatagatacgcacatctgttgaagaatcaatatcaatcccatctgtacttggcccatcattatgacggatgattactttttctactaatacatcgttagaataagtgatttgcaggttccaaaaacctgatttttgaaaaatcaaatcacgaatgacaacatgttctgcatgatacagtaaacacgcgcgcggacgcttaatagcataatctgcaatccaacgcagtccctttcgatcatattcagctcttgttccgcttttttggtctttcccccaatatagttcccaccaatgctctccttgaccgtcgattattccttttccttctataagaatatcttttgctgagagaacattcaaaatcgctgctggccatttcatttctattccagcaactcgtgtatcaatctctggaaatgcttcgatctctgtttttcccttgagaacagccccttcttcgaaaatgagatggctcttatcttttaaaaaaagtgcgccgactaaataaataccttttggaataaatacgggcaagtgttcttttgcaccttgattgattgccttttgcagcattactgtatcatcttgttgaatgtcgtttgttttaaagtctaaagcattgatgaactcttttttgtctgcaatacttttctccttatctttcattgattttttttaattcttcaccaataaacacagttttcgaacgattcagcggataccctactaacaaaatgattgcggatacaaataaacagaatgctggtagcaagtttgccatcgtataaattctttcttgtactaaaactgattggatagctccacctgttgtagacgattggtaaccaatgagtgctagcataaatcctccgactgctcctgcgcacgcttgtcctacttttctcgcaaaagaattcactccgtatactgttccatcttctcttaagcctgtcttatattgatgatagtcaatcacgtcagtaatgaatgcccagaccatcaaattgaataaaccagatcctaaagtagcaataaataaaagaatcagatatacccatgcatttgttatatgaaggaaatacatcagcaagtacatacatgaagaagcgagtaacgcaaatacgcttgcttcctttttaccaaataattttgtcagctttgtagcaaatggtgctaaaactactactgttccgtaagtaaataaaagagcaacagacattgcttgtttattatggaagtaatcattaaataaataagtcatattcgtcccagctaaaatctgattgatcacaatgaaaatgtcaacaatgactaaaataatcagtgctcggttagccaacaaaccttttaccaactgagaagcaggcactttttcgtttttgacaactcttactcgttcagtagtcaatttacaagtcagcatgtatgcgacaaatgcaattgccgcacatccgatggaaatccaaaagaaatgattccccgaaacgacttgctgcccactcttgttatgggtgtacatcaaaatcgggataaagaaccctgtagttgacccgccaatcgcagaaccaatgcttcggaatgtggatagcgaggtgcggtcattaagatttgaactaatggctgctgccattgctccgtaagggatattgattgttgacagaaaaataccataaacaatatatgaaacaaaaatatatgcaatcttcaccgtcattggaagatgttggacgaatggtaaaaacaaaatgactgtcactaagcaaaatggatatttcatttttctgatccaaggaataaatcggccagcttctgttaactctgagacatcgcataatcttccaaccatcacatcagcaaacgcatccaaaattcttgaaatcaagaataacgtacctacaattgctcctgaaacaccaagaacattcgtataataaatcatcaagaaactattgaccaaacctaaaataaaacagttacctaaatcaccgaacatgtagcctatcttatcggaaatcccaaattcctttttttctttttttactgtatttgctgtaacagcattttgtgaaagcatttgaattcctcctacctcttctagtaaacgttttcaaaattataactctttttttcttgttttgatattcacaatattgacattttattgcattatcttgacagaaaaaaaacaaaaatacgtttaaaaacattgtcagaaaagggcattaatattattttcataacatcatagataaacaaaaagattcactaactagcaaaaacaagttagtgaatctctatttattagagagttagattattcaagatcttttccttcgtacttaaaaaattcaaagtccgcataacttcctctttttctattcaaatcatgtacgactatcccgataaaattcccggtaaatccacctgagagtatacacatgtttttttgtagacctacttccttccattcttcagatggtgtgtctttcaaataaaactgtgctgtctctttccttacggctactttcaagaaagtcttcttttctgtgagtggaatcctccaatcttctatttgtgcaactccgttttctgattctatcatacgaagacattttcccttgttctcattccaagtaacatagcaataaatataattggattcatttaggtacaataccagtccagccatctgattaaaattattaggtgtatattcaaatgctgtctccgcatcaaaagtaaaatccgtttgccgaatagctaataaatgatggtcaaaggtagattgaagagattcaccggcaatcagtcgtaaaaaaccaggtctagtttttgtatcacaccaatcagcccttggcaaaatacgtctggcattccagttcttttttaactctccttcaaatgtatccataaactgatgatctctctcttgttgtacctcttcattcgtctcaatcattatttcttccatcggagttgtctggttatctttaagccttaaccaatcgtcggacgtccaatacacttcttggatagcggtttctcttcccaaaatagccgcaccgtttaatggtctggtacaaagatatgtcatgtaccattttcctgacggggtttgtactaagctcccatgtcctgtacattgcaatgtagaagcaggtttgtcactagctgtcagcataggaaaaccaggatcaagctcgtaaggaccagtaatcttctttgctcggcagactgtgactgaatgtcctcttcctgtaccgccttctgctgtcctcaaataataatacccgttacgaaaatacaaatgcggtgcctctgttttcgctaattctgtacctgcaaatattttatagatgggaccgtcaagcttcttcttctctgcatcatattcttgcaatacgataccgctggatttattcggtgtgtccagacgataatcccataattcattgacaagccattttttcctgtttccaaatcatgaaacaaagaaggatcaaagccgttactatttaaataaatcggttcggaccaaggtcctgtgatctcagatgcagtaatcaagtaattgtggacatctttaaacggacggcctgcacttttgacatctgtgtaaacaagatagaacaatccatcagcataactgatttgcggtgcccatatgcttccgtttgtaggatttccttgcaaagatacttgagtggtcaaaatatccgttgtatgtgaccaattgactaaattcttcgactcatatactcgaattcctggaagccattcaaaagaggagacaataatgtaatatcggtctttcgctcttaaaatattaggatctggattgaaccctcttaaaataggatttttcactttgatagtctgcatgattcaggcttcctttcttattcttactcgatacaaactgaataccccagcggcaaaataaaaaaatgcaaaaggaaacgcaataaactgagtgccgaccaacaatataactcccgttataaaatacaagccagtggcagttgttaagtattttcctttagccgtcaaaaatagtgctactgctaaaaaagaaagtgaaataaacaatacaacggcaaacagaccagtcatgtcctgtaatagctcaaatgtattttctaaagacaaagttggatgatcgacagcaagcgactgataactttttttaaactctgacgcagacatattacttaaagtaactgctaacccgccaaagaaaatcagagataggctgccaccgatcattcctagcaatagttcccattttcttttcatttcagaaccccctgcttttctaaatggatccattcaggtcttttgattggtgtttcataattgttatttcgttcagagaatttggcagtctgttcatttttcttgtcatcccaattgtcccaaccagttgggtgaacatgcccacctatcttacacgcttcaaacacgacatttgcatacggacgccacggtcttcctaaatagacgtttctagtatcaggctctgcagtcaaggtacagctttcaaaacgataccctgatttttgatttttcggcgtagatgctgctgtgatgtatccaggatttttactggctaagctatggatacggcactggcgaaaaactgcatctgccccaccaaatatgaaatccaccgttccttcaatccaacaatattcataggtctgacgacaataatcgggattggcagaagccggtgtacaaaaaggtgtaccatctttttgcaagtcaggcaacggacccgtgcataaagtatcctgataaccagttagtcgacagttttttaacaatacgcgatctcctgaattgaataaagcaacagcttgacctactttttctcctggacctgctgtattttcgatgtaaagattttctaatacgacattcgatccttctaagaaaaaagtagcacttcggaaagtccctaactggctaccgtcaagatactcctgttttgcaaaacgattaccagagatcactactgttcctgttcccacaagtttaaaattggataatctactttctatatattcatcatatcttccttcttttactatcaagacctttggatggctatccggcaggtctgccaaataatcgattccttcttggatagtttcaaaatccgtcggggtatctatagaattttttccaattatcagtttgtctttcatcctcataaatgctcccttatgaattgtttccaaatgtttctcatttcttgtgtttccatatgaccgcctgttaaagaaaaagaagaaaagttttctggactacccattgatcgatacttcttgtccagtccttttctcagcttcagtacgccttcgtccaagcacatcgtatcgttttttccaactaagctaagacgagggcgcggagcgattttttcttggattgctaacgttgtataagctgtcagtaggtttggcacatagtaataaaacccatgatgatctaggcgacgatgtagcaaaagtgtttcgatgtccacctgtgccgctagatcaatacaaactttgacacgagaatccaatgccgccacccaccagcttaataagcctcccatagaaagaccaatcgttgcgatccgttgagtatctgtgtcttcccttgtctccaaataatcgatcaagctgatcacatcataaatacgcattccccataatgtttttcctgttaataaaaattgtttgaacaactcgctttcggaaatacctccgcgttcttcaaatccccaagcatcaatcgaccaaacagcatatcccattcctgtcagtacttctgcaaaagatggagaagctaagtaaggagcaccatggatcaattcacttttcccgactgaaaaatctccgccgtgagaatgcaggtaaaggaccgtcggaaacggtccttctttctccgggtaagcataaagtactggtactgtttccaattcatttaagtacagttgataatattcaagcataaacccattttgtttttctctgtataatcgctttccactaggagtaagtctgctagatggatcacctaaaaagtcattcaactgcataagcaaaatttttacgaacaaccagatcatccatgttttccgattgagttgaccggaatttctcaatactgatttctttcgtattttctaatagaaatgctggtccttcatgattctcaatcgtcatttgattaaaggtaaccttctccgcaaaaccaatgtaaaatccttgcttgctcatttcctctatccctgtcatcatagcagggacaccgggaactgcatcttgggccattgaaacatcaatattatcaaatgtgatttcttgtataaactgttctgctaatccataaataaatcctgcagaagcatggacattccttgccgtgatattcgaaaaatggatccttctgaatgctggtgtccgctcatctatcggataagccgttttttcccatacatatggttcttttcctcgcggaccgcagaaataataaagattcagtataaatggacacatcacattatccatgactatattggatactcgaatatcttcaacgttcccgcctcgacctcgtctagatttcaatcgtattcctcgatcagtttcttggaagatacaatttgaaatggtaatattacgtatactaccactcatttcacttcctaacacgacccctccgtgtccatggaccatcgtgcaatttgtaatcgtgatattttcacaagcaattctttcgtacgtatcttcagtccctgctttgattgcgatacagtcatctcccacgtcaatatggcaattactaatacgcacatttttgcaggattctggatcgatgccgtctgtatttggtgaatccgccgggttcaaaatcgtcaagttgtcaaacgtcgcgttgctacaaagaattgggttgatcgtccagcttggtgactggatcagtttgatatctttcacagtgattcgatggcagttatggaaactcatcaatttaggacgaggataagccagattatctggttcgtttcggaaagtatgccaccatttttttccatttccatctaatgtaccgaaaccagtgacagagatgttctctacattttgtgcatagatacaggaagcatagacttttcgatggactccttcccaacgtgaatgaacaataggataatcttttggatcgtcagagaatttcaaaaccgcccctgcgctcaaatgaagttctacattgctttttaaaaataaagcccctgttaaaaattcacctgctggcacaactacggttccgcctcctgcgcttgctgctgcatcaatcgcttgttgtattgcttcagtattcaattcatcaattgatgcaccgaatgtcaaaatatcatacatacttataatgcctccacttcgatcaatgcttgcaagaatgcaccgacacctttttgatcattacaaataatcggctcactgatgtagtaagcgtatgaaccatctcgctgttctgctccgcctaaccctgctacttgacagtttttgttcaagttcaaccagccttcttttgtttcaagaacaaattcatcgagtagtccttgatgagattttttcacttgcggcagccactcttctttgttcagcaagcctaagcgtatccctttagccattgcgtaaacaaacatactgctgccagaagcttccagataatttcctttccgttttgtttctgttgttacttgataccatgtcccactgttttcttcttgatacggaagtaatgcggtcaatgtcttttctaaaatttccttcagcaaagaacaatccgtttccgcatgaagcaattcataggtatctgccgcagccatcagataccagccaatcgatcgactccagaaatgatgagataaacctgtttctggatcagcccatggttggactttcttttcatcccatgcatggatcagtaaatttgtttttggatcaaataaatgtttatagctgatttcaaactgtctcaagacatcttggtaatctttttcctcactaaaattctggataaattcagcataaaaaggtgagcccatatataatccatcttaccaaatttgataaggataaatttctttatgccaaaaagccccttcggatgtacgcggatggtttgccaactgccgggaaaggagttctgctgcttttttatatttttcttcgcctgtttctttgtacaataaaaagaaaagctttcctgtatttacatggtcgatattgtattcttcaacgctgtagccacggatcgttccatcttcttgcacgaaatagtcgatattgtcttttatgaaatcaaaataaattttttcttgggtttgttcccaaagtaattggaaccctttaagtacgacgccatagtcataagaccattttcctttataccacttttcttcatataagcgaggtgttctttccatgatgctttttgctaatctctttgaccagttttccattatttgctctcctttaaaaattaaaataggatttaggacaaataccaagaagtatttgtcccaatcgtctatattactgtgccgctgctttgtatgcttcctcgtattcttgtgtgattcggtcgcctccttgtgctttccagtcttctacagctttcttgaatccttcttcgtcaagctgtcccatgatgtattgcactgtagcatcaataacgattttttcgatttccgatcctacttcattgttcgtcggtgaatccaatggcacagaaggatccattacagcgaattcttcgttttctttgatcaattgattcgacaattctttttcaggatctgcgtctttgaaagagaacgttacttcactagggcgagaacttgatagcggttgcacttcttgttgccaaagatccatatcgataaattcgatagaaccatcatcattcaattcataatgtgttccctcaataccaccagtcatcaatttatacatatcttcttctagaagatcatcaacaaattgcagtaatttcttcaattgtgcttcgtcttttacttgtgatttagggaatgctaacaaaccaccaataccatttccttctgaccaaacatgataacctccgccttcaccatctgaaatcttgtttacagggactaattccatatcatcttgaataccttgtcccattgtcttcaggttcttgatatccaccatcccagtgtagattcctgtttttccttgtgcaaattgttcttgctggtcagtcttttgagtaaccgcaaaatcttgtgccaaatagccattctcaaatagatctcttgagaagttcaacgctttcatgtattcttctgtatcaaattctggagtaaatttgccattatcatctacagcccagccattcggtgctccaaaataagaagtgaacagcttaaagctggtataacgaatatcactaggcgcacgatcaccaaaaccaactgtatcatccacaccatttccatctggatcgttttctgtaaattgtttagctacttcgtaaagttcatccatcgtagttggaacatctaatccaagattatccaaccagtcttttcgaatgactaaaccagcacgagcatagtccttttgcattggcacaccatacaatgctccgtcgatacttgcagcttcgattctatcctcagagatttggcttaagtttttatagtcttttaaatattccgatacatcccagaatacgcctgatttcaacgcacttcggacagaagagtttttcagcatagcaatttgaagtgtaacgatatctcctagttcgtcagaagccaatgcagttgtcagtctttcttcttttgaagcatcaggaatccaattgaatgtaagttccgtatcggttttttcttctattagattcacgattgtgtcagttggtggggaagcatggtgtaaaatattcaaccaagtgattttggttttcccatcttctgtttctgaagaactgttgtttgaactgttgccacatgcggcaagtgctaaaattcctgcaaaactaagacctaattttacgagcgttgcttttttcataaattttctccttcactgttttaatgatatttttgttttcttctgttttttctgtatatgagttcttccattccaaatggcaaaatatagaatttgctgtccacgtgactgcggaaaagaagagactgccaccgataaaggttaaaacacctggcattgtttggatgatcatcaggtaaatacccaccagacttagtattaatactaatgaataatgaagatgagagaatccgaacaaaaatgccattttcattttgaaaaaatatcctttccaatcataatgtgccatgattggaaaaatatagagtgctgagagcaaatacaagaacgcagcaatatacaaagcgattctaagataccaattgtgtatgaaagaaagatccacaagtaaaacaactccgatgacgccgtatatccagctcatcagcaaggtttcacgatagttttctttaaaatatgagaagtacgttttcgtcaaaggaaatgtttcttttgtgcgcagccattttctaatcactgcaaccattgcataagatgcaggaccaaaagtaaaaacccccagacctgcaatgactaaaccaccccacagaaaattcaaataaaccaactgtaaaatacgatttagccttccatttattttatctaatgactgcagcatgtcttttcctctctttctaaattagtaaacgccgtcttctcctagctttttggcgatcttgttagctaaaattaccatgaataatcctacgacccctttaaacaatcccattgctgtactgaaacttaattgtccattcttcaatccagctgtataaatgtaggtgtcgaaaatttctgcaacacttcgattcaatgaattcaataacaagtacatatgctcgaaacctaagtccagtgtctgaccgatttttagaatcagcaaggtaatgattactggacgaatcgccgtcaatgtaacatgccatgtttttcgcaagcgtcctgcgccatccatttcagctgcttcatataactgtgtatctactgcagtgattgctgaaaggtagatgatcgtagaccagcccaactctttccagattacttgtccaatatagactgttcgtgtccactcaggagatgtcagaaaactgattttttcaaatcccatcgttgcaaggaattcattcaatacccctccgtcaacgttcaaaaatacataagtaatcgaaacgatgattacccaagacatgaaatgagggatgtaaatgatcgtttgaatcccacttttcagtcgcttgttcgttacttcgtttaatagtagggacaaaataattggcatcggaaaaaacacgaagatatttaacccgaacaagatcaaagtattccttaataaagtaaagaaagtcggctctgtaaacaaacgaatgaaatgtttgaatcccacccaaggactgcccattatccctaaaaatggttgataatcttgaaaagcaataacgagccctcccataggaagatacctaaagatcaggaaataaaggacccccggcagaatcatcacgtataaaaatttattcgttttgattcctgcaattattttttttcgtcttctgagcttttcttcttttttcgatagcgtcagttgaaatggttcttgtttctttacactttccataagcccctccttagttttatgaatgtttgctgcttatgtctttatgatagataactatccgaattacgtatataatcatttttatcgcatgtaaaaacgcttacacagcagcgatttttatacttgcaaaatatataagtgtatttcttcacaaataaggtacgcctagtaactattctatttttttctatctgacacttaacgtaggaaatgattatatacgtaatctttcaccgatgataaattgaatacatagaaacagaacatttaatttattttgaggaggagcctatctatatgaaaaagaaagtctctataggagaaagaagttttacatttttcaacaatacgtttctgatcttgctagctttgatctgtatcgtgccttttttaaatatcatcgctacatctttcgcttctacacaagaagtcgtcgcgaaaaaatttatccttttccctactaccttttctctagacgcgtatcgttatattctatctacgccaactatttttagagcacttgctgtttcgattggcgttaccggggttgggacgatcgtcagcatgtgcgcaacttcactgatggcatacgggctttccagaaaatacttgtttggtcgaggattcgtcaactttcttgttgtattttctatgttgttcagcggggggatgattcccacattcttagttgttcgttctctgggactggtcaattcttattgggcaatgatcttgcctgtagctgttaatgcaatgaacatgatcattatgagaaactttttccaagccttgccggatagtttggaagaatcggcaaaaatggatggttgcacagatttcggtgtatttttcaaaatcatgctgccattagcgttaccgtctattgctactatctcacttttttatgctgttacttactggaacacttatatgaccgctattttgtatatcaacgattcatctaaatggccgatacagattcttttacgtcagatcgtcattgtatcaagcgggatgcaagcagaaagtagtgccgttgatgtgattccaccagcacaaacagttaaaatggctgttatcgttattgccacagtccctatgctgattgcttatccttttgttcagaaatactttgtcaaaggcgcactcgtaggttctgtcaaaggttgattatgtatggaacataaaatagaggttatgaaagagacgttcagccttatttttataagctgtctcttgaataccgtttattcgcaaaaaaggattgtgacaaagctttggtcacagtcctttttgcgtgcttagccttgaaatttaactattcataaagacaaatactaaggttattctcctttcttttattgcttgaatcagaccacaagaaaaacagcctcttgtttcacaaatatttttttcgatattctcccggagtgattgattctttctttttgaagaaacgaataaaattttgcagatttcgatattgcagtctttctgcaatctcttttacagagagattggtttctttcaaccactttttcgctacctctagacgatgattttgaacgaaatcaccaaatttttctcctgtttcctttttaaatacattgcttaaataattagggttatagtgcaacctatcagcaatcacatctagagatagatcacggtcatattctgtatagacgatgtgcatgatattctccgaaagatttttaaattcatgatcagtgattgcttgagaacattctgtgattggcaagactaattgttctaaaacaagtttttctagctctttgggatgataattgttcaatgcttttacatagatttgtttcatgttatcaaaattttttgaatctactcccaataactgccctaattgaacgagctcattgatcaaacggaccgaaactacttctcggctcagaggatttttattttgtgcgaacaatgcattaattaattcatgtaccaacttccttacttcctgatttccggaacgaatagcttcaaacaatcgattctgttcttctactggatatctaataagcgttttttcatgcgcagcaggaacaatttcctgataaaatatgatcgaactcggaccagtatttacacgataatatagggcttcttttgctcggtcaaccgattgcttgctttcattcagcgtttcgaaccggttactgatacctatactcacagttaatttcaagtattcttttacacgtttttgaatgagtcggcaatactccatgacttttttgcttgcttctgcatcgtctttatccattcgataaatagtggcttgcatttcttcattcaaaacgatcggcagcattcgattttcctttggcacaatttccgtgatcatgttgttgattgctaaaagtagcaaatcacgctctccaccgtgactatcttctaacagatcgatttgaaccaaggccgtataatagcagtcagtttgagaactataaccaaattgctgcaaccgctgatctagttctcgcctttctactcgatttctaaataaactgagtacaaataacgtttctagttgcggcttttgggtaactaagtgtgcacttaacgcttctttttctcctatgatccgactgactgattgagcgaccaaatctagttctttcccactgaatccttttgatttaagattcaaacgttcctgaatttgagaaattggacgggcaaatctatccgaaaataaataggaaaggagaccgatcagtcctactagcgtcaaagacactgcaactaacccgattctcagattgcgaatcgttgctccaattgcactagaatcaacttctaatctgtaaatccaattattataatctgatttcagtacgatataggatgtcccattttctcttatcactttcaactggttgtaatctagatccacatccgctaatgcatctggctgctcttcttcttttactttctgtgtagaaaaaagctttccatcttcgttttcgatagaaagtatatcttctccgctttccccaacaacttgttctattgtatgtttctctatcgtagcaattcccaatgcatatttttcttttgccaaaataaattatctttgttatttatgtacttttgttgatacctttcaacttcctcttcagtcagttgagtcaacgatccattgattactccccatttaccagctaaactgagtaaatcataattattatcatccataacaattgtttctataaagtttagctctttcctgatttcagaataagtggagtaatttgtatatgtcagtggatgcttgaatatatccgagaaatttttggtcgaaccatacgtagaaaacgaatattcgatcgttctgattttccattcaacgttcgttttgacttgcctgagcaggttctttttatctgttaaataactcgattcgatcgactcataggtattctgataaataaataaactaaatcctatgacaagtacggctcctaataaaaacatcggtaaaaatattttataaaacactgtacttttcttcattttcttcctctctttcctttaaataaaaggctttcatttttctgtaaaattgatactcatctaattaaatgagcattccccgcttttaagaatagcataattaaaaataaaaatccaagtaatttttaacgtgtgcaatcttttcgtaccaaagatctattgacttatcgtagttatcgtaatatgatgaatgcgttaacaaaaagtgaaaaagtaaggaaaatgatggaatggtaacgatcaaagatatcgctaaagcagctggtgtttctcatacgacagtttctcgtgctttgaataacagcagtttaatcaaaaatgaaacaaaacaaaaaatacggcaactagctaaggaaatgaattattcgccgaactatagtgcaaaaggtttagtaaatcaaaaaaaatatctgatcggactgtttttctcaagtttgcataaaggaacttcatcaaatttcctagcagattccattgcaggtatccattcagtattggacacaaactacagcttatctgtcgaaagtatcgatgctgttgatttaacagaaatcaatttgcaacgttatgatggtctgatcgttatgagtcaaagtgatgaagatcagccttttatcgattatctaaaagaaaaagcgtttcccttcgtcgttgtcaatcgtcacatcaatgatccagcggttatcaatgttactgccgatgatgcggccggtgttatgcaggcagtagattacggtattgggtgcggacatacgaagatcgcttatattggtgggaaaaaaaactttcgttcgacaaaagaacgggaaaaaggtgtattggacagtctaaaaaaagcaagcatccctgccaatccagcctattttttaacaggagactacagcttagaaagcggcctcaaaaacatggaatacctattatcgctttctgacctgcctactctggttttttgtggcaacgacgatatagcgattggtgcattgagagctgtacattcagctggtcttcgtgttccccagaacatttctctgattgggttcgatgattctccagtcgtctcctatcttaatccaccgcttactacagtacacaaaccgttgaaagaaatgtgtcaagtaggaacaaagcttttattggatttgattgaagacaggccgatcgaacaatctaaaatggagctctccaccttactgatgcttcgtgagtcgatcaattacttgtaaactgcaagtaattttatataaaaatgttaacgtgtgcataacacagaaaggaataatctatgaataaactgacaaaagaattagtgaaaaaaaacgaggctcccgtaaaagttcttcaattcggcgaaggcaattttatgcgcggatttgttgattggcagattcagcaactgaataaccagcaattgtttaaaggaaatgtcgccatcattcagcctctagaacaaggtcttgggaatatgatgaaccagcaagacaatttatatacggtcattttacaaggactcagcaatggcgaaatcgttgatacttccgagattatcaccatagtagaacaaatgatcaatccttatcatgaatgggatgcttatctttctctagcagaaaatgacgacttggcctatatcgtctccaatacaacagaggcaggaatccaatttgtggagactgatgaacgaacagatacgccaccacagagcttcccgggcaaactgacagcctttttataccgacgtttcgaattaaacaaagccggttttacgattattccttgtgaattgattgacagaaacggtgaatgtctaaaagaaatcattttacgctacgcagaaaaatgggatttagaacctgcttttattgagtggttagaaaaagaaaatgttttctgttgtagtttagttgaccgcatcgttccaggttatcctcgtgaggatgcagctgttttcaatcaacgacataactatgaagatcaattgatggtcaaagcagaaccattcatgctttgggtgattgaagggcctaaagagttggagaatcaactaccattcaaacaggctggcttgaatgtcatcatcacagatgatatgactccttatcgtgaacgtaaggtgcatttgcttaatggaccgcacacagcgatggtccctcttgctttgttggcggaattggaaactgtagaagaagtaatgaaagatcctttattctccgcttatgttgatcagctattcgatctagaattgattcctatgctttctttacctaaagatgaattagccatttatgctgatcaaatcaaagaaagtttcttgaatccttttgcccatcacaaattagaagcgatttcattaaatagtgtttcaaaattcagcacccgtctgcttccggtcttcaagaagtatatcgaagaaaaaaatcaagtaccaccgctaatctctgtttcactagctgcgttacttcttatgtatcgaggcgatcaagtaaagccccatgatgatgaaaagacgataagcgaatttgttgatgcttggtctgataatgaaacagctattcttcgattattgcaaaacgctgcgctttgggaagaagatttgtctcaattaccgaatgtggcagatactgttcaagaaatggctacaaaaatcgaacaaaaaggtgtccgagcagtattacaagaaatgaaaggaacgatggtccatgcttgaaaccctgcaaccaacaatgaaactaaaccaacgagacagtgttgttgtcgcattaacacctatcccaaagcaaacacaactgacgattgatcagcaaacgatcaccactcttgaagatatcccgcaaggtcacaagattgcattgagtgatttgaaagctggagacaacgtgatcaaatatggctatccaatcgggcacgtgacgacagacgtaactgccggtcaatggctgcacactcataatgtaaaaaccaatctttctggtgaattggattatcgatatgaaaaagatgtccatccaagtcattatccttttgagaaccgaacatttcaaggctacttacgaaaaaatggaaaagtagggattcgtaatgacttgttcttagtacctaccgttgggtgtgtgaatggtattgctgaactgatcgtcaaacagttcaaagaaaaacatccggatctgggacagtttgaccatattacgattttaaagcatccctacggctgttcacagcttggaaaagatcatcaaaatactcgagaaatcttagcagacgcggtaaaccatccaaatgctggcggagttttagtgtttggattaggttgcgagaacaataccgttcctgaattcaaaaaaattttaggtgaatatgatgaagaacgagtgaaatttctagtggctcaagatgtctatgatgagatcgaacaaggcgtagctctattagaagaacttttaaccgcggccgaaaacgaccagcgcataccagtcccgctctctaagttgaatgtcggtttgaaatgcggcggttctgatggtctatcgggaataactgccaatcctttgcttggtgcattttctgattacttgattgctcaaggaggtagcacgatcttaacagaagtgccagaaatgtttggtgcagaacaagtattgatggcacgagcggaaaatgaaaaagtttttgattcaatcgttgacttgatcaatgacttcaaacagtatttcttgtcttacggggaaccagtttacgaaaacccatctcctggtaataaagcaggtgggatcactacattagaagataagtctttaggctgcacgcaaaaatcaggaagctctcctgtcgttgatgtactgcaatatggcgaaaaaatcagaaaaccaggacttagtttattgcaagctcccgggaatgatcttgtagctgcctctgctcttgcttcatccgattgccagttggtcttgtttaccacaggaagagggactccgtttggctcatatgtccctacggtcaaggtatctacgaacacgactctttttgaacgcaaaggtcattggatggactttaatgcaggcgtcttattagaacaaccaatggaagtgatcttagaatcatttgttcaaaaaatcatcgctgtggctagtggagaagaaacgaaaaatgaacaaaataacgttcgagaaattgccatttttaaaaacggagtaacactttgattttcataaaaacagtataaaaagaaagaaggaagatttatgtttttatctgatgattttttattaaaagacgattgggcgaaaaagctttatcattcctacgcaaaaaatatgcccattattgattatcactgtcacttagatccaaaagaaatttacgaaaacaacaatttcagcaatctgacagaagcttggttaggaggcgatcattacaaatggcgcttgatgcgagcttgcggcgtgcctgaagaaaaaatcacaggaaatgcttctgattttgaaaaatttttagcttggtgtcaaaccgtaccaaaaattatcggaaatccgctttacagttggtcacatcttgaattgaagcgtttcttcgatattgacttgttgataaatgaagaaaacgcagagaaaatttggacacaagcaaataaaattttggcaactcctgatttccgtcggcgggaaatcgcgaaaaaatcgaatgtagaagtgatttgtacgacagatgatccagcagatgacttacactatcatcaattgcttgctcatgaagaaccagatttgaaagttctcccttcattccgtccagataaagcactcaatattgaaaaagaaggatttaatgcatggatcacactactggaagaagcagctgaccaaacgattaccacctatcaagaactaatcgaagttttagagcagcggatagaatacttccatcaacatggatgtcgtgtttccgaccacgctttagacaccttacgctataaagaagcggatgaaacagtattagaagagatttttcaaaaagcacgagctaacaaactattatcttcagatgaaatcgatgcttctcgtacagaaacactgatacgtttgacccacttctatcattctcataattggacgatgcagctgcatattcatgcttatcgtaattgtaatacacaaatgttggaaaaattaggacccgataccggttatgatggaatgaatgatctttctttgactattcctctgcaaaaattattgaatcgtgcagaagaaacggatcagttgccaaagacgatcctctattcactgaatccaaatgactaccctgcgattttagctttgatgggctgtttccaaaaagaacagaatggaaaactgcagttaggttctggatggtggtacaacgatactcgagctggtatgcgcgatcaattgacacagtttgctgatggtagtgctttggggaattttgtcggcatgctgacagattcaagaagtttcctttcctacactagacatgaatatttccgtcgtgttctttgtgaatttttaggcgaaatggtcatgcgaggagaagcacctgaggatgaacaacttttaggaagtctcgttcaagcgattagttatacaaatgctaaaaattactttggctttttcgcctaattgattaatagtaacagtaacgaatcaaaacaggatagcgaaataacggaatccgtttatccacgttttagagaagaagacggaccaaatttgctccgtcttcttctcttgctgttctgcttcattgcctataaacccttatgaaagaagagataacatgcctactatccatattgccggtgattctactgcggcagaaaaagatgaaaacaagcgtcccgagacaggttggggagaaaaaatctctgcttatttttcacctgagatccagatcaataaccaagcaaagaatggacgcagcaccaaatcatttatccaggaaggaagattagcccgtttagcttcacagtttcagccaaatgatttcttatttgtacaatttggacataacgaccagaaaatccaagaagaaagaggtacgctccccttcggtagctatttaaaaaatctgcagatattttttgaatgcgcaaaaaaagcgaacgtccacatggtcttgctgacatctgtgacgcgacgagattacttagaaaatggaacattgaatccagatatacttggagactatccaaaagcgatgcgtgcatttgctgagaaacaccatattccacttttagatgttttctcacgatcacaagaatatttccagaccttttcaaaagaagagacaaaaaaattctatctgcatcttatgcctaatagttgtgaaaattacccagaagggctaaaggataatacccactttagtccagaaggcgctgataaagttgcccgaataattgctgaattgataaaagaatcccgtctgcctcttgctgattatttacaaaaaggagtttgagatgtttccattaaatttaggcatccgtgcccatgatctagaggttcgaaatcgtgaagaaatcgttcaaaaagtatcacagcttcacttgtcccatatccaatttgcaccacaaaaagcatttcctgaacaacttaaattaaatgacatgacacttgggagtgctgcctattttggtgaatacttccaaaaaaacaatatcgaactttccattttaggttgctatatcaacctatccagcaaaaatcaagaagttcgtgcacaagcattagcaactttcaaacagcaaattgctctgtgctctgcctatcaagccaagatgattgctacggaaaccggtagtgtctctgtcggtttcacaaaagaaaattttactgaagaagcttatcagattgctagaaattctgtcattgaattagtcgctcatgcagaaaattttggcgtaactgttgctgttgaagcagggatcaatcatccgatctataactatctgttagccaaacgtttagtcgatgaagtagcttcaccaaatttaaaaatcattttagactgtgcgaatttgatccacaaagaaaatcatgctgatcaggaaaaagtgatccgaggtgccttggacaatttacagggttgtattacagcgcttcatctcaaagactacatcatggaaaatggaaagatccgcatagttcctgttggtaaaggctgtttagatttccgcccggtactacattatatcaaatatgagcgtcctctaatgtacgccactcttgaagctactcctgagatttatgttcctgaagcaatagaacacttgcagtttttttaccaagattgttaaggagaagattatggaggaacgaatacagaaaagttatcaaaaatatcatgcaaatgcttttcagacattgctgcatctttatcaggggaattattggcgctttgccatgtcaggactcttttttattatcaaacatcttccatcttggttaatgccgattgctattgccaatgtaatcaatgcagcttcatcaaaagattcctctcaattgcaggcgatttatttcaacgcttttttgatgacttgtctgatcggtcaaaatatattgacgaattattttcatgtaaaataccatagcacttcgatccggcaagtagaagctggactaagagcgactcttatcaagaaaatccaagaactttctattccctatcaaaaagaattgcaatctggccggatccaatcaaagatcatccgtgatgtagaagccatccaaacgttgtcctctcaagtatttgtcagcggattgaacattgctgtcaatttattcgtggctttaggtatcacgctttatagaagtcctgtcgttttcttgtttttcttattgactgtccctctcgccgcgttagttactctttttttccggaaaaggatcagacagtccaattcagatttccggcaagaaatggaagagacttctgcaaaagtgatcgaagtgatcgaattagcaccgattgctcgagctcatgggttagaaaaacacgaaaccactcgcttaaataagcattttacccaaatctatgaaaaaggattccacttagatatcctgcaatctgttttcgggtcagtcagctgggctagttttcagatatttcaactggtttgtttgattttcactgggatattagctttacaagggcgtattcaaccaggtgatgtcgtgatgtatcagacatatttcacaacgatcgtcaattccgtttctggaatgatcacactgattcctacgatttcaaaaggcatggaatctattacttctattggtgaactgttgattgctggcgatgtagaaacttatcacggtaagaaaaaaatccaacatttggatggaaattttcgctttgaggatgtttcttttcattacccggactcactcaagccgattattgatcatttttctctagaggtgaaagctggagaaacaattgcttttgttgggccatctggttctggaaaatctacactccttaacttattgattggatttatccagccgtcttcagggaggattttcctagataatcagcctttggatgaattggatatgcgaagtgtgcgtaattatttagccgttgttcctcaaaccactttgttgttctccgcttcgatcaaagagaacatcacttatggcttgaaaaacgtatcaaaagaacgtttagatgaagtcatcgaagctgcgcaactttcttcactgattgaccagcttcctgatggactggataccttagtaggcgaacatggcaacaagctgtctggtggccaaaaacaacgtatctccattgcacgagcattgatacgtcagccgaaaatcattttgctagatgaagcaacttcagctttagataaccagtcagagaaaaaaatccagcaggccctgaattatctgacagaaacacccactacttttattgtggctcatcggctttcaacgatcaaagaggcagataaaatcgttgtgatcgatgaaggaaaaatcgttgagatgggtacttacgaagagctgttagctcaagagggctatttttaccgtttgaaaaatgaatgacaaaaaaaggagagacgacaagagttttgtcgtctctcctatttctgaacaaacggtgttctcctgccaactcctcggtcacaaatcacaatagtcatcaaacatgagaagctgttttttgaaattgttccttgtcactcagagttaaacggtaggctcacgtctttttggtaaacggtgttcaagagacagtctatcggcaataagaagcaactttgtcatcgctcaaggctgaacgtctctttcacaacctctgttgtttcataaaatagttctattcgctgtaaaggtcgcgaactggcgtcatgatgatccggttcaagtcattgatgatcgtactgaacccttgttctttttgcattaaatcattgattacttcttctgattgaattttcacagccatttcttgtgctttcattgcatcttcgtcgctgaattcttgtccactcatttgtttttcttgtaattcgatttgcatcgcttggaagtctttgaacagcttgtgtgcttcttcgtttgcttgtactttctcgtacgcttctttcaacgctttgaattctggtaattcacggatctcacgttcgatctgattcgcgctatcgtagatgtttgacatgttatgccctcttttcttttagtagttactctctattgtaacatggggttattcgttttcaaagggtctactctccttgatatttccgccagaggtctttagccgcttcaccaattccctgaacgccttctttcaccgtatcgccgaaattcttcaatccttcttttgcttgttcaccgtattgattcaagttatcttgccaatttccagactctccattagaattacctgtgtttccaacttgatctgctgctaccacttgccctcctgtggcataggcgtcagctacactaaatcctgttttggaagtataaggaaggataccttctgccgctgatttgaagactttcccgacaacatttccacttgtcccttccaaataatgcagcttgctggattcttcaaaccccatccatgtcgaaatcactacatctggcgtatacccgatcatccattggtcatttgctttcgtggcatcgaaattagtttctgtggttcctgttttacctgctatcgtataacctgcagggttcgcagcagctgctgtcccatttgagaatgtaccaagaagcatgctggtcatttcatcagctgtttcctttgatataacctgttttggctttttgtttgtattatcgatgatcaccgctccagttgaatcaacgattttcgtgatgagatgcggcgtatacatctgaccttcattggcaaatgcactgtaagcacccgccatgatcattggagatactcctttttctaatccgccaagagctaagccataatacttatcagattttgctaaaggcaggccgaattcttctgctttatcatatcctttttgtaaaccgatctcatgcaaaagccatacagcaggcaagttcaaactttgtgcaacagcctgatacatcggtacttctccttggtatgtcccgtcaaaattatgcgcatcgtaataactttgcggttcatctttcaagacactagaaggcttgtaaccagcttccaacgctggtgtatatacgcttaatggtttgatcgttgatcctggagaacggcgcatctgtgtagcaaagctgaatcctctaaagacatgatctcctcttcgtcctactaatgcttgtacaccgcctgtattcggatctaaagctactgaagcagattggaccatggcaccatctgaagcatttgctgggaataatgcattattttgataagtagcttctaattgcttttggtaatcctgatctaaagctgtatagattttatagcctttattcatgacatcttcttcatcaagaccatactcgttaactgcttcatcgatcactgcatcaaaataataaggataacgataaccagaatctgaattatcgtatgtgtcatgaagataagcactgatgtctgtctggctttctgcttgttcttgttcttttgtgatttttccgttttcttccattacgcttagtactgtgtttttccgatcattcgcattttctgggtgatcaatcggattataaataccaggacctttcagcattcctgccaaagtagcagcctcagatagcgtaacattcgttgcatctactccgaaatactttctggaagcgtcttggacaccccataccccgttaccaaaataggcattgttaagatacatggtcaagatttcttctttgctgtacttcttttcgatctcgattgccaaaaataattccttcgcttttcgatcaaatgtttgatctaatgtcagataagcatttttggcaagctgctgagtgatcgtacttcctccgccccctgatgttccgccagacaaaaccatccgaacagccgcacgggcgattcctttgatatcaaatccgtgatgttcgtaaaaattcctatcttctgtcgagattaccgcatcttggatatagggagaaatcgcgtttaattctacgtatgtccctttttgggcgtacagtgtgccagcttcttcatttttcttatcataaatgactgtcgattggcttaatccagattttaacgtttcgacatttgcttgtttggctaaaataaaaaggtagatacttgtcactaagacacagatcaaaccaatcagcaaaatcaatttgttcacatgatattttttccaaatgcgctttcgccatcgatggaattgtccgagatatggtctgatccatcgccaaaaactgatcaaagcagcttttatctttcctaaaatgctttgaaaatccattcgcttcttctcctgtctattcaattcaatcgtcttattttaccataatgaaagagtgttttcttcctgcttaagttgtagttcgatttgtttttttcgttagtgcaagtagagtaacataagaatgaacagaaaaatgtaagttttttcttaaatatgttttaaaaatggtacaattaatctgcaattttaccgaaaggagtacacttgtgaaaatcacgatcactttacctatgaaccatcctgaaacaacgattcgcgacttgcttgaaaaggaatggttagttcctagaaaggttcggcactttttgcgtatacgtaaaaacgtttggatcaatcaacaacctgctttgttccatcatgaagtaaaaggcaatgaccagatcacattgttattcgaagaaacagattataattatcaagaagtccaattaggagatgcgaagcacatccgtgttttatatgaagatgaacatttgattatagtggataagcctgcaggaatgaagactcatccaaacgaaccaacagaaaacagtaccttgctcaatcacttagctgcttatctcgatacgaaaaaacaacgaccttacgttgtccaccgtttggacaaagaaacaagcggcgctgttttatttgcaaaaaacccatttgtcttgccgatacttggaagaatgttggaacaaaaaatgatctatcggagatatcaagccatcgtatgggggaaaatcgccaaagataggactattaccaataaaatcggacgcgatcgccatgatcggagaaaacgggtcgtagatgataaaaatggtcagaacgccttgacacatgtcactgtcgacaaagtactttctggaaaaacacaagtgtattgtgttttggaaaccggtcgtacgcaccagatcagagttcacttagctcatatagggcatccaatcgttggagaccctctctaccaaaatagaccagctgaacgactgatgctccatgcattagaactgcacatgatccatccatttactcaagaaaaaatagttggtaaagctttacccggattgtggaaatagaaagaagaacgtagtcctatcattatctgctgataagactacgttctttttgtgtaacttgtctgcttacttttgatgttcgtgttctgctaacagcaaactaccgataatcccactttcatttggcagtccccaacgaacgatatattcacttacttgaggtgtttccatgtagccacccatcaattcaacaaattgctgacggattttttgaaggagatgatcctgattcattactccgccacctaaaataatcttttcaggtgctaacgtcaacgtatagttgatcagtgcttgagcaatatagaaagcttgaatatcccaaatcggatgatcttgtggcagatcttgccctttgatccctatacgtgcctcaatagacggacctgccgctaatccttctaaacagtctttatgataaggacaagtgccttcatattgatcatctggatggcgttttacccaaatatgtcccatttcaggatgtgcgatccctgaaaaaatttcctcattgatcacgacgcctgcgccgattcctgttcccacggtaaggtaaatacaactatttttttccttgtgctgccccttgcttcagctccccgtatgcagccgcattgacatccgtcgtccaagcaacaggaatatggtagcgtttcctgattgtgccgagaaaatcaaattgtgcccatccttttttgggagttgccaaaacatatccgtaattatcttttgtttggtcgataccaatcgggccgaatgagccgatcccgattcccttcagttcataacgatcaaaaaattcaaatacttgatccaatgtttcttctggtgttgtggtagggatacttgttttttccaaaatctctccaccttctgaaaccgcacacacaaattttgttccgcctgcttctattccgccatacatttagttttcctcctcgaatccgattgtccgaatttcataaggttggattatcgggacaaccgattgctgcgttggttcttcaagcagattcaatatgaccgtttttcgattgtctttagttatttctaatttttccaaatgactagacatattgaaacctctcactactactttatcactaaacttactccgtttcaaagctgtaattgcaaacgtttcactttttatcgttaaatattgttgttttgatgccaatgttccttcatgatgtttgatttgttgagtggagaaaggaatctgtgccgcgtatgcatgcaaataagtagagaatgtttcttctggtccatgtagttcaacgctataattgaaccgatgcttacctaaacactgtgcttctggtgttggaaaatacccccaatctcctagttctcccacacagcgaagtagtgtcaccgcgatttgtccatctgctgttacttcatattcattcaaaccaaagttaccaactgttacaccgtactgttcatcatgaatattgacaaatgcttgctgatgttgcggattcgtgggattttcccagctcctagatacatggtttgggcgctttactacttcaaaaatactatctgcttcgtgatgttccacatgtaactttgtaggaaacaagacacgcaatcgatgatctttcatttgattgtcaagagtcgtttcaaagtcgatttttttactatcttttctgactgtcatgatcgtttctatttgaaggatccgtttttctttagatcgttctgctttacgataacgaaattctacaaccatccgttgttctttctctaaacgctcgtctgcagaaactgggatctccatttcctgtagaatacttattttggctatttctggtgtatctactaatacttttacttcagagccctcttgattactggataggattggttgatcatagacaggttgcttaaagatatactcgtttcctatatcaccgatatcttcaaaaatatgcaggttattccattttcgtttgtttttgcgatcttccattgtaatggtaccgtttttttcaatcgtcaaacgcaggtgggcgttttcgacgattcgtccactctgacggatcattgtttccttttcttctgctttcgcttccccttctacaagcgcgaatgtttcccaagaaaacgctggcatgttttttattggtaaagttaccttgatcgttcttgccatatatggcacacggaaacgatctttcggcaaatcataaccaaattgtacagtttcttcagataaaatagctggtatagtggccccgctttttgtttctacgtgatacttccgtctaggcaactgttctaactcttgatacagatgttccggtattccctcagcgaatctttttcttgctaattcgatggttatttctgcttcgccagttttatccattcctgcagtatttacaacgacaaatggaaagctgtcttttggaaatccagttgtatcgatcgctgtggccagttgttctaaagaatcttgtgcaagatactttccgacttcatctgctttttcaaaacgaggtatcatttcccgatggacagaatcaactgaacaaccgcaaatactgtcatgaggatgattttgcattaatgtcttccaagcataatctaattgatcgtggggataaatccctgtaacttcgtaagccatcgtcgcaagtggttccgtgatgttttctagctgccgttggaccttggtattccattgtttcaaataaacgcgagcagatgctgtattggctaaagtataccagccatccgtttcttgacttgtcaattctccttctactgaacctaagtcttctggcaactcttgtcgaactgcttccagatagtcagtaaaattagaatggatgaactcgtaatctggaaacagctcatttgcgagatgaattgcttttgatatatctttttgtactggttgatgatcaacaccattcatcattaatagatgatcagtagatgcatattgttctgcatctgctaatttctgcttccaaaagacacgagcagcttctttttctacgggaatctcgttcccattgctataccaattggcaaataacagaccaaaaatttctgtttgatcaggtcctttccaccacatctctgagtattgagaagaatagttttctgcttccagaacttgattgtcaaagccaattggttttaccccacggccaaacgccgctgctgaaataccagcttgtttcattaattgaggcgtctgtcccatatttccaaatgtatcgggaaaataccctaacatgacgggggttccccatttacggctttcttccatgccaatcagcatatttctcacgtttgattccgaactgatcagaaaatcatcttgcaagatataaaatggtccgattctcaattttccttcatcaatagctcgttggagtgcctgtcttttttctggtcttacttgaagatagtcatctaaaataatcgtttgcccatccaaatgaaaactgttgaaggacggatcaacttcaaatagctctaataaatcgtctatcaattcaatcaaccgcatgtgatgctgttcgtaagccatgtaccattcacgatcccagtggctatgagaaatgatatatactttctttttcatttacagtacctcctatttttctactcgaatatcaaagtaatccataactaattcgcaaaacatcatatttgcccaagaaaaccattctctcgtataattttcaggattgttcacatcaaatccttcgtgcataagatgtgttcctgcatcagttgctacaagcaaattcaatagccgttctttttcagatttatctggtgttgtcattccttccatagctaacgcaatcggccaaacatactcttttggcgtatgggaagaaccaattccttttgcgtactttccttcataaaaacatggattctctttactcaacaatgttcttcttgtttgaagataatcttcctcttgttccgaacagtaacccaaataaggtgccgcgatcaaattgggcacattgctgtcatccatgaccgtcgcgttccccattccatctacttcgtatgcataaatcgtttgccctttttgattaaccgtccgtccgtgattttggataccttcttggatctctttcttcaatatttgtgctttctgtacaatttctttatcatcgagtatcgtttggaaaatttcttccacataacctaacacgaccaccgcaaacatattggatggtaccagatatccgtaacggcaagcatcatcgctaggacggaacccagaccatgtcatacctgtaaaagttgttttggctcctcgtccgtcattgatcagcgtatcttcttttcttgtcgtatctcgtacaaatgtataaggagagtgttcatgatcctgctctgtttcgaacacgcctaagatttttttgatcccttcaataaaagttgggttgaattggtccgtttttcctgtatttttgtaaagaagataggccaactgtatcgggtagcataaagaatcaatttcatattttctttcccagatccaatcgttcatttttgtgtgatctgtttggtgtcctgcaccgttcgcttcttcattgaaggcattcgcatatggatcgatgttgatataaaaaaattgttttttgaccaacccactaatcatgtcagctagttcctcatcttcttttgcaatcactaaataaggacgaacttgtgcagtagaatctcgcaaccacattgcaggaatgtctcctgtcaatagaaaagtagtaccgtcattttgctttttgactgttgtcaatagcgtgttggcaaatgctgctgtaaaattcgttgcccagtccgcatgggttttcccgcatttttgtgtgatatcatccataaatttttgcaccgactttggtatatctttataaaccatacaaatctcctcttttcatttgatatatctttaaagattatatctcttgcagcattttatgtctacgctttcaaaaaaaataactttttatttactttttcatctattatggtattatttgaatatgatatatcattaagaggtgtttatatgaatcaaccattgtaccagacaatatttaatgatttgcaaacggctattttaactggtgaattacctgtggatagccaactaccaactgaaaaggaactttcccatacttataaagtaagcagaatcacttccaaacgtgcattgactgaattagaacaattagggctgatttatcgcgtacgtgggaaaggcagttttgttaaatcatctgctccggagcagatgcttccttctcctacaaaaacacggcggattctgtttcttcttccatatgtcgctgatttatctgttggtgattttaccaagggattgaatcctgtgatgcaggataaacagatggatgtcatgatgacgacacatgattttttacaaaataaaacggcaaaagaactcatccatgaatttgatggattaatttattatgcctttgatacagaacagcatcttgacttgctttttgagctgtcattaaaagaattccctgtcatcatattggataaaaaaatctatgaattgccttttcctaccgtgctttccgacaacttccaaggtggtgtgctcgctacttctcatttgatcgaacagggacattcaaaaatcgcttatttatttggtgcacagactcatccacaatccgtacgtcagcgttaccttggttaccttgaagcattggacaaagctggtttagctttccacacttcgctggatgacaaaagcgcgacattcgatgaattgctttcttatatcactaagtatgaagtgaccgcttttgtttgcgaaaacgatgttgtcgctatccagacgatgaatttcttgagacagcatgattatcatgttcctgaagatttttcaatcatcggatttgatgatatccaagcagctgctcttgttgatccaccgctgacaaccattgcacaagattttgaacagttaggcaagcttgctggagaggctttgatcacttggttagagacaaacgaacgtccttccgacagcaaatttccagtttcatttatcaaaagacaatcaacaaaggagaaataaaatgaatatcggtcaaatagatactagacatggcacagctaatcagccaaatttctctaacgggaactgccagccttacactggcgttccttttgggatgaattattttgcaccgcaaacgaccgatcaaaacggcagctggtggtttcatcctgaggatcgtgtttttcaaggttatcgacttacccatcagccaagtccttggatgggcgatttcagtcatatgctgctcacgccaatcaatggtaaattacaggaaaataccctttttcatgcgcaaagttcttaccgcccagaagaaagtatattttgtccgactcatctgtcgatccgtcaattgcgttatggcatccgctctacattgatacccagtatgtatggcggaatcttatctattgattacagcagaaatgatagcggtttacttttatcctttccgggacgtcatcagctctttgttatagatccttacacagtggaaggaaaaatcacacattttgctggttcagaagatcctgatttttctttttatttcatattgagatttgaatatcctttaacaactgatgagctagctgtttccaacaaaaatagcgattcgatcccgttgtattttgaacagacaaaaaaacaaaccatccgattcgggacatcttttatcagcccggaacaagcagcttataacttggaactagaacaaaaccaaagcaaagagacttaccttgctaacagccagaaacaatggcaatcctattttgatcgtatacagctcacacaccatgatcaacaacaattgcggacgttttatcataacttctatcgggtgtttttatttccgcaaacattttatgaaatggatcctagcgggcaaaaaatccactatgatacgactagccgatctgtgaaacctggcgttctctatacaaataacgggttttgggatacgtataaaacggtttatcctctttattctttgattgctgtagaaaagtacgaagaaatgctggaaggtttcttgaacagctatagagaaactggttatttgccaaaatggctgtctcctgacgaacgtggactaatgcctgggacattgatcgatgcggtcgttgcagatgctgctgtgaaagatattcggccagacttgatgcaggaatttctaacagcaatgaagaaaggcgctacagttcaaagtaatcattcaaattatggacgacaagggacagaggattacttgacatacggctatgttcctaatcactaccatgaatcggtcaatcatacgctagattatgcttatagcgacttttgtattagtcgagttgccaaagtactagcagaggacgaaacggtgaaaaaatatcagcaacgatcattgaactatcaacatatttttgactatgagtcaggatggatgcgttccaaagataaaaatggcaaattcagagaaccattttctgctcatcgttggggacaagattatgcagaaggcagtgcttggcaaagcagctttgctgtttatcatgattttgcagggttgatcgaaaaatatggcagcagtgagagattcaaagaaaaactcattgatttgtgcaatcaatctccgacatttgaaacaggaggatatggttttgagattcatgaaatgagcgagatggctgcgatagaatttgggcagttagctatctccaatcagccaagttttcattacccatacttgttcagctatattggacaacccgaaatggcacagccattgcttaaacaattgatgactcaaactttcgacgattcttcaacgggttaccctggagatgaggacaacggaagtatggctgcttggtatatcttcaatagtctgggattctatcctgtcacaccagggaccggtgaatatgttatcggtatgcctttaatggacaaggctgttgtgcttttgtcaaatggaaaggaattgacgattgaaaccactcctaatcggccacaacagcaatttatccataaaatcaaacggatggacaaagaatatacgaaattatattttactcatcaagatttgctgaaaggcggcaagatctcttaccaattaggtatcgtccctcatcctaagaagtatcgatcaaaagatttgcctttttccttatcaaacgataactaacaaaaggttgtgaaaaagctgtcctgcatcaagtaataagaacagccaaacaaaaatagctcctcctattttcgtttggttgggcttattaccgcagatgcaaacttttgaacattgattcattccatacgcttctttttttaggattctcctcttttttcccgatactccttaggggatctgccgacaatcttcttgaataatttagagaaatacgtggtattgttgtagccaatctcacttgctatttcattgacgttttgattactgtgcaaaagcagctgctttgctttttccatacgtaaatggttcaaataagctgaaaaactttttttcgtttcttttttgaacaactgccctaaatacatgacatttaaatgcaaactttctgacacttctttgagtgtaagtggttcttgataatgctgatgcaggatttcgattactttttctacattgccactgtattttttctgtctctggtgcttttggacgaacgacagaagtagctggtggagttcttgcaccgtttttgcctgatgaattttttcgattccttgtaaatattcctcatcttctagatcaatcaattcccgttgaatctccataaacagtaaaaagctggagtaccggatgtcttccggcatcatggctgctaactgaaattgctcgaaaaaatcagtgatcattttttgggcatcatctaatcgtttattttgcaacacacgtctgaaacttgaaaaatcgatggtttgctcttttattgttgcttgtattgcgtaaaaaacatgctcgtctttatctccataaaattgatgtaattgtagattgtctttcgcttgttggaatgtttcagggatcttgtccaatgaatctgtctcttccccgatactgatcagccattcctgatcagggatgttttcttggacaaaacagcagaatccatcaacttcatctgcctccaacaacagcgtaatcaatatacggtctccataatttctttgataataaaagatttgctggtgttctttcaaccatgtattgataagaggatcatgaattcttgataattggatcaatactattctatgctgtttctcactgatttgtcctattatttcttcttcacttgcttcatctaactcttcattcaaccattgactgaataatagttcctgatagatttcttgctgatttttttgttcattttgctggtctaaccgtgttttgattttcttgaggctttcaatcaattcgaacttattcacgggtttcatcaaataattcaccgcacctaattgcatgcctcctttcaaataatcaaattcttggtacccggacaaaatcataaattcaaaattatgatgttctttttgagctgcttcaataaattccagtccgtttatttctggcatcgtcacgtccgttaccactagatcaatccgttgttgttcaaggacagatagtccttctttggcattctccgctgttgctactatttggaaccctaaacttttccaatcaattatcttttttaacccattcaaaatcatatattcatcatctaccaataacacctggtacatattcacccctccttgaatgtaatagaaacagtcagtccacctgtctcattattctcaagcgacatgtaataactgctgccgaagttggcacgtaaacgttcattcacgttttgcagaccgattgattcgtgaagttccactttgggatgagacagtttttcttccacctgttttagccgtttttcagtcatccctcttccattatctttgacgatgatccttacccgcttgtcttcctgtaagactttgacacttagggcattatcaaatcgagtaaaatcaataccatgtttaaaataattttcaactaatggttgaatcacaaatttaggtacttcaatcttttccaaatcaggatcgatcataaaatgataggccactcgattaggataacgcatttgatataaatagacatatttttcgcaaaagtccaattcttctttcaaagtgatcgtcttctcttgatttgtgttgtttcggagcaaggcagaaaaagcatatacaacatctgctaattcttcgcttccttcgctgattgcatacattcggatatattctaatgtattgtataaaaaatgcggattaatctgtgcttgaagcgcccgcatatgtgcatcttgctgtttgatttctagtttgtagatgtcttcgacaaattgattgatgctatccaacatttcgttgataccgatcgaaagttcctttagttcatattccgtttttgttgtatcaatccgtgtttctaaatttcctgctgctgtttgctccattgcctgcatgacgacggatatttgctgtgaatatcgtttgaatgttttataaagaaagataagcaatatactgtctaaaacaatgataccgacaatcagaggggcaaggtttttccccgtttcggtttttacgctttttttatctaatacagctaatattcggtaatcatccgacagttcttgatgctgaacaaaattattttttctcagattagcaattggcaattgtgaatttttctgaagactctctgagataatcgtttcttgtcttccaaatgtttctttagctattttattatcatggaacgtatacaagcgatttgtcgtgccagaaatcatgtataaagagagtccattgaatgacgttagattctctaaaatcgtatctagctctttcttttggaaaccgataaaaatactgcctgactcagctcctccttgggtgataggcaacttgatataaaaggcgtctagtaatttcggcgttccggcttttacttctccgcctttgttttctctagaggattcatagtactccggtagctgattcaacacgatatatatcgcacttagttcttcataatttatataaagatctttgatttgatttgggaaagaaactaattcgtcggtactgttttgctgctcatatacatacatcaaatactgatctatgggttttgttaagtaggtagtgacattttcgattttttcggaatcacctacaagctggtttttaatgatcctactcaaagttgttttgtcattcagcattctgcttgtactttgaacggcatcacttgtcatgttttctgcctgcttttggttttgatcccacgtatggacactaaaaataacagtagcagtcatcgttacaccaatcatgataaccgcatatttccgtaatagccgattcagtaaggttccttttgaaaatagaatccggattttattcataactttccaactgtttatctaactcttcacgccactgtttcgtcatcgtaccattccaaaccgtcaaaagaccaatgacaccaaataaaatcaatcctttgaattgccaagtcacagctataattacactgctaccaataattatttttagaaaagacgaaaagctggaaaaaaacgaaataaaactcagctttagcagattaggaacagagatcgtatattcactgtctaaaatcatactgtattgataagtagcaaataggcaaaacaaggcaaaaagcaaaataaaatcaatagctaaaaaaatgagccctttgatttgaacagatagatatagattgtagctcaataaagcagtactagataaaaataaactaaatagcagatttcctcttaaaaaatttcttttatatatattccagcctctttttaacgtgatttctttatactcgaatccatgtaaataaaataactcattgactgttttccatgccgtacctaatccaaagatgattccgccgacaaacgtgtatatccagaaatataaggttagttttataacgacccagatccggataaacaactcttccaaaaccttccctaacatatcttctcctccaaacattaagtttatactttctcattatacaaaaaaaggttgggcaatcagcaccatgacctgagtattaaaggttgtaaaagagctgccctgcatcaagtaataagaacagccgaacaaaaatagctctctacgtttttcgttcggttgggctgattgccgcagatacaaggttttgaacaccattcattcggaacaagaggttgcgacacgtttttgtcacaacctctttgtctttattcattattgttcttgtcgaaactcgtcatattgtttttgcatttctttcaataccttgtcataaccagctttatctaaagcttcttttaatttcggcaatgtttcatctggatcaacagttcctgtattcaatccatccaaatactggttcatgacatttgaaatattacttaattctgtttttacattgtccgtgttgaagctgaaccctaaaatcggtgaagtttctgcttcagcaatcgattggtcgcggttggcaatcatgtcatccgtaatggactcttgtgtatatagaatcttattgtttcctgtattccaagcagacatatgtgtgtttggctgataaccatctagcaatttgattttatcctctgaaccatcgactttttcccatgcttctccttcgattccccaaacaagtccattcaataattctggatcactgttaagtaggcctagaagttctactgatttttctttattttttgaagtattggatacgacaaaatttgccatttgtgcttgagctgtagatttcaatggaacagtaattgcttttgaaactagttcttgttttgctgcatttgtcaaaatcgtatcgccataatcatagggtccttgtgtttctccacgcatcagccaagtatttccttctagtggatagtccttattgctcgttgcagcgtcacttggaatgagtccttgtttgtaccagctatgcatcgtacgcaacagtccgatatacgtttcattgtcgtattggttgatgatttttgaatcatctccatccagatcaatagcaaatggtaaagtgttccctaaaggatagtcaaagtttccttggactttgaatccttgtccaatggcaaaagcggccgtgtttggttctttttcatggaattccttcaaaactttttctgcatcagcgtaagattggattccatcaattgaaagatcatatttatctagtaaagctttgttaaaagtaagtacttgttgagcaaagacatttccatttactggaaaggcatataatttcccattcaccaaatttcctttgatataagcttcatctaaatcattatacgctttttcagcatacttaggcgctaattcagtcaaatcagcaaaggctcctttttgagcattggaaacatagttgttcgcaaaggcgatatcgtaattttctccggaagaaatgatgacgttcattttcttttcgtaatcgccccaaccaatgtaattgatattgacttttgcaccaatctctttttcgattcgtttgtttgccacttccatcaattgatcgaaattatccggtttatcaccgatttgatacatctgcaaagtgtccgaatcactagcttctgcttgctctttagaaccagaacctccgcatgccgctaatgtacctaccaataatgctgaaacacctgtaaaggctagtttcttccataacttcatttttcttcctcctagttttatgatttttatatttttttattcttttactccaccgatcgttagacctttgacaaaatgtttctggaaaaatggatagctgatcgcaataggcaacgtagagataactacgatcgccattctggcggattctcctggaactgaagctagcccacctgtcaattggcttcctgctcctgaattttgcgtcagatattgaatattactttggattttcatcaaaagatactgtagtggaaccagcttatcatcttgaatgtatagtaaagcattgaaccagtcattccagtagcccaatgcggcaaataagctgattgtcgcgataccaggaacagctaacggtaaaacgatttgaacgaatattcgaagttcgctagctccgtcgatccgcgccgattcaataatcgaatcagagaccgaacgtttaaagaatgtgcgcatcacaataatattgaaggggccgacagccattggcaagatcaatgcccaaatcgtatcttttaactggagaagatttgtcataacaagataattggctaccattcctggtgagaacaacatcgtaatcaaacaaaaaacggtaaaaaaacgacggaatggaaagtttgaccgcgaaatcgcaaaagcatataaagaagtagccgtgctattgatcagggtacctaaaacagtaacaagtacagtgacgaaaagcgcttgcaaaattttatcctgcatctggtcgaataaatacgtataaccaaatagactgaatttttctggccaaaaactgtacccgtgcgtcgacaatatggactcatcggtaacagagatggcaataacaaatatgaatggcaaaacacaggaaatagcaaagagtgcaatcattatattagagaaaaaattggtcgtcttattgaaagaacggacttggactctctccactttcttttttttcatttttttcctccttagaataatgcagaatcgctatcaaaacgacgggcgaccgtatttgtgatcatcaataagacaaaaccgacaactgattgataaaggcctgcagcagccgtcataccaaaatctcctgtggatgtcagcccattgtagatatacgtatccaaaacttgagtcacatcgtacaatgcaccggaattcctaggaatgttataaaacaggccaaaatcagctcgaaaaatgtttcctacggctaaaatcgttaaaatcgtcatcaatggaatcagttgtggtatagtcacatgtttgatttgctgccatttgctagctccatcaaccatagcagcttcataataagtcggatcgattcccataacagatgcaaagtaaatgatgctgttataaccaatccctttccatgtaccgatgaatactaagataaatggccaatatttcggttcattataccaattgacagcttctcctccgtgtccagtaatccactggttgaatattcctttgtcgggacttaaaaaggcgtaaacgaagtaactgataatgacccaagatagaaaataagggagcaacgacatcgtttgataaactttaacaagtcgtttatttctcaactcgctcataatgactgcaaatacgactgaaatgaacagatttaaaaggataaatgtcacattatataaaattgtatttttagtgatgagaaatgcttggtccgaagaaaataaaaatttgaaattttcccaacccacccaaggactttccctcaggctagccaggaacccatctgctgaaatatgaaaatttttgaatgctacgacattcgccattacaggtatgtaaaagaaaaaaatcatccaaagcatacccggtacagccatcaggacaagtgctttataacgccatagattcataaaaaaatgattgaacccctttcgttttttcatctaaaaacccctttcgattcattcgcaacgttattatagcgctttcaataatgagaataaataaacaaagtatagggaaaatgaaacaaagtataggagaggttgtgaaatcagcgttttgtcctgagtattagacagatcgtgaccttgctatctaactccgagtcacaacgagcaatggggactgtgacaaaagtcttgtcacagtcccttcttccgaacaaacggtgttccagaagtagcttctacggaaataagccgaaatttcacaaaaaagccatccaaaagtcagacggataagtctgcttttcagatggcgctacaactacactgcttattcttttagctgtccattcacttatttttctctcacttgttctagctcttctttggtcatggggcgatactgccctctattcaaatctttaggaagacaaaaattccccatacggattctttttaaatataagacttcttttcctactgctttgaccattcgcttgacttggtgaaacttcccttcatgcaaaatcagacggataattgaagtttctgactcttgatctacttgatcgatttggagttttgccggcaatgtctgctcatcaccatcaataatcagtccttctgcaaataaacggatatcttcttctgtcattatgccgttaacctcagctagatattctttctccacgtgtttttttggtgataataactgatgggcaaataccccatcattcgttaaaatcaggaggccttccgtgtctttatccaatcggccaactggaaaaagatcttcccgataatcttgatcttccaacaaatcgattacggtttgatcatgattatcctgagtagcagaaatgactcctgcaggtttatgcaaaatataataaaaatctttttgatacgcaatgatttctcctaaataagtaaccgtatcttcaaactcgtttacttgcgctttatcgcttttgaccacttgtccattgacttcaatcgttccttttttgatcaatcctttgacttctttgcggctaccaagtcccatatctgctaaaaatttatctaaacgcatgcgtttcccccatttcaaaagagcattgattctgctcttcccattcacttattttatttttaatttgtgtcgtaaacgcgctattcctggtcctagtagtctttctgccaaacggattttcaaagctaaataaccgtacaccaatgcccctatacctgctactgcaagaatcaataatagagactggaatttgctatcttcatttaagaaagtcccaaaaatcatctttgtgatccacgaagcaaaaagcataatcaaggtaagaataaagatcagtaatgtcctacgccagacaaaacttggtttaaagcgagctacttcatggatcctctttaagatcaaggtacaagacacagcaaacccgagcattgtcgctaataaagggccatacacttcaaataaacgaatggctggatattgaagaagtagtttcaccagaaacccaacaaccaaataattgattgccgccctgttttcaaacattccttgcagcatgttggaaactagcatatataaccctaagaagagtcctacaaaacttgcttggatcagtacattgcttcctagagaatctggtgtataaaataatgtgttgagcggataggcaagtaacatgacaccaaatgtcgctggaaacataaaaaatgaaaacagttgtaaatttccgctcgtcaattttgccagtcctactcgatctttcaacgtaacagcttctgtaatcaacggtaacccggtagacgcgatcgatgttgccaatgcgataactaccattgtcaatttatctggattggcactaaaaatcgaaaaaagatctagcaactgtgcattggaatattcagtggatgcagacatgaccctcataaaagtgaattgatcgactaatttgaagattgttacccctgaaccaacgataataaacggtattgcttctttaatggtatctaacaacaattccttcgttgcaatatttactttgttttcgctgtagtggataaatgcagatgtatacgcttgatgtttcttcaaaaaatacaaaaggacaaggatacttgctagcataccgataaatgccgcgaaagttgattgcgtgaccgccgtcacataatcgccattcatgactttcatgatgatgaatgtagccaacagcatataaaaaatacgtgcaacttgttcaacgatctgcgacagcgcataaggcatcatctcttggttcccttgaaaataccctcgtatcacactcatacaaggaaaaaccaatacagcgatactcaaagagcgcatcgttggaatcagttcttctccgccaccagaagcatgagctagccaaggagaggcgatgtacatgaacaaagcgaacaacagacctaacccgcccatcatctgtaatgcccggatgaacaatcgtcgtgaagtgccatattcattcaacgaattatatcgcgcggtttgttttgcgatcgccgcgggtattcctgctgtagagatcagtagaaacaatgcatatatattgtaccccatattgaataatccattggcagccttagcattttcgcccatccaagcataccaaggaatgatatagacagctcctagcaaccttgaaatgatattactggcggtcatccaagcagagcctcgtgccattttttcttgcggtgataattgatctaatgctggttttctttgattatccatcggtcagattccaactttctacaaaacattactatcattttaattggtaaaacagaaactggcaatcgattttatataacttttataagaacgattgtttttttgaattcggtttcgtttttttggtaaagtaaagaaatatacagccttttatggctaacatttataggagatatcaatgacacaagaaataaaaaaactacccgttatatttttaggtcttttctttatcacagttggattgaattggttcttgctccctcatgatatagcttccgccggagtgggcgcaatcggacatttagttgaaacggccttttctatccaacgctcagttactgtttggagcatcaatcttatgatgctgcttctagccgctgttctattaggaaaatcaatattttttaaaactgtagcgggaagtctgctttttcctgttgttttagaaatcgttccaaaagtggaaatgctctcctctcatttcttctcactgatttcaggaagtcttttgttcagtcttggcgtttacacattgtacaccgtcggagcctcaaatggcgggataacgataccgccaattatttttcacaaattttttcggcttccaatgccgcaaggactgttacttacgaatagccttatcatctttttgaattattatgtatttggatggttggagacactgttcgttctcctatctattacagtcagttcattgtttatgaaaatactcatccgcttgtcccctgtgtcaagaaaatttgaataaagctggattttgtcacagcggaatcaaacgatatatatcaaacgatatattgaaaagagtgtgctataataaatcaagaaattgaatgaagcgagggatcaatcaatgagcttctctttagaagacatccgtcatttactattaaaagaacatctattaaaagaatttgtttcaacaaaaggctggcatcttgatgtaccagaaaaagctgaatttcttcagttaagttatgattcaagaaaagctgatgcttctactctgtttttctgtaaaggaatgaatttcaaagaagaatatttggattcagcgatcgaacaaggtatccaatattatgtatcagagcagccatatgaaaattcagcagtaggcatcattgtgacggatattcgtaaagcaatggcacttcttgctatggccttttacgactatccacaaaataaattgaaagtgattggattcactggaacaaaaggtaaaacaactgctgcgtactttactaaagcaatcttggatcacacaacgaataaaaaaactgcattgctttctacgatgaatacaacgctagatggcaaaacgtatttcaaatcccatttaacaacgcctgagtcattagatttatatcgtatgatggcagaagcagttaaaaatggtatgactcatctagtgatggaagtttcttcccaagcttacaaaacacaacgtgtgtacgggttgactttagatgtaggaatcttcttgaatatctcgcctgaccatatcagtccgatcgaacatccgacatttgatgactatttctattgcaagcgtcaattgatcttaaactcaaaaacagttgttttgaatcacgaaagtgactattttgatttgcttaaagaaaccgccgatctattccagatcccaacgatcacttatggtcgttcggaagaaagcaattatcaagtgattcattcagacaaaggtacccacgggtttactttatcttctcgtcaagatcacttagctatctgcgatactgcttatgatattttgctggccggaggattcaatcaagaaaatgcagccagtgcgatcattgccgcagcactaacaggtgcctccagtcaagatgcacaagccggattaaaagaagctcgtgtaccaggccgaatggatcaattgatccaatcaaatggggcgcatgtctatgtggactacgcacataattatctaagtttgaaaacattgctggaatttgccaaaaatgaacatccagacggtcgtgtaattgttgtattaggcagcccagggaacaaagcaatctcccgtcgacatgattttggaaaagtgctatcagaaacagctgacgttgcctttttgacggcagatgacccagcatttgaagatccgcaaaaaatcgcggaagaaatcaatgaagcaattactaatccagaattgatcgttcattatgaaatggaccgtcctgaagcgattcggcgtgctttagcagaaagtactccgcaggattcagtcgtcattgcgggaaaaggggttgatccctatcaaaaaatcaatggtgtagatgaaccttacgaaggggattatgcaatcgtgaagcggttgattgaagaataatgttatttatattctagtagacgggacgccatgaaaagaaaacttttcatagcgtcccgtctatggaattatcaagaaaagttgccggaactacaataatttttattgtttctttatcatgcctcttaaagatagcgcttttatttgttttgattactggctcttctatcgttgcttttagtttattattcctgtcttttcaataatataaaagtggttattatgaaaaaatttttcaacttagctaacggtatcttttttctgtcatttttctaactttgaatttgcaaagtggcaaaatgggggccgttattttcagaaatctccatttgccagttgatgcatcgattgttggatggttactgctacttttttcttacttgatgagtcggaagcatcagactaagtttttcgcgcgcttaggcggaagggttgctctattttttctagtcgtttatctgatattcacatgcctaggtttgcttcagtcgctcggtattctgccttgatacttcgttcgaatcatattgactataataaatagaggctgggacagaagcgtttaactccaagaaataagaaggaattcacgaaaattgcttttcaaatttttgtgaatttcagcttatttccgaaggagttgcttctgcttccgcagtttatacgtgtttagagcgtgagacaaaagtgttctttacttttgtcccacgctctattttcttagaaatcagttagctgacttttcactagctgattctgctgccttttctctttcttcattcaataatttactatcataaaatttaataaatgggaaccagataatgaatgcgatgattgcacaaaagacagctagcacagctgctttccaatcacccccactgccgacaaatgcgccaattccaactggtgaaggccacggcatctgtgcaagcatcggtttaacgatttccagccgaatggcaaaataagcgagtgtagcagaagccatcggtgctaagaaaaacggaaccgctaaatagggattgtagacgattggcatcccgaaaataattggttcgttgatattgaatagtcctggtacaagagaggcttttcctaacactttcagctgatccgatttcgcgaggaatgcaataaagatgatcaatcctaaggtcgcgcctgatccaccaacggttacataagaattgttgaattctcctgccaacggataatttgcgccttgtgcgttagctgccatattagctaatacgattggggtcaagaaagaagtgatgatattcgctccatggatacctacgatccacaatgcatggatcaagaaataaatcaccatgacaccaagccacgtattcgtcagctgcgtaacaaacccaaatgggatagcaatcattttgaagatatccgttcctagtgcaactaataatccattgatgatcatcaccacaaacgcaatgacaaatgttgggatcagagcggtgaaagaacgagaaactcccggcggaacaacatctggcatttttatgacccaatttctcttgacacacatacaatacaattcgaccgcaataatcgacataataatagctgtaaagattcctgaagttcctaaacgttcgacaaaagagcccatccgtatcccatttactacagtttctgtctcattgatagaagcaatcaagctgattttaccatcggtcatgatcaactcagggatacacataaagaatgcaaaaacagatagtaatgcccccgtgagcggattaacattcaacttttgttcatctcgttcaattgacgttaattcataagcaaacacaatggcaaagtaaatagataaaatacccatcgtcattgtattgacgatcatgtacaagtcactaactttgaaaaaagttgcattaaaaaatccttctaaaaatgggaacggtaatggcaaaatattcaaaaccaaaaacatcgaacctacgatcgtgaaaggaatagaagccatccccgctgccatgacagcccgaacgattttaagttgcgcaattttccccataggtcccatcaggtatttctgcaaaaaatcaaacattaattattctcctttcctaaatacaacgctttttcatattgttttatacggatatactgctgatcttgattgagcgaaattttctttaaacgatactggataaatacactgacaaaaataccgcttacaataagaatgaaaacaaatagctgtcctctattgttatttgccataaaaggatacaagagtgtaaatcctgaggtgaacaacactggaatcaataatatattgcagacaccctgaaacaaaaaataccgctttgtccatggaacattcgtttggtgctttcgataaagctttacttgttctcctactgcaggcaaaatagctaaaagtagaaccattggtaaactgcttcctaaacttttagctgatagaagcagaatcatccattgcatgttcatgaaaaagaaaaaggcagtcagatagcgtacgaacagataacgattgaaatacatgtttttcaaactaagttgctttttttctaattcgattttcctttttactgtatcctgcacaataaatcttcctttctatttatttttttgatacaaataattcatttcctgtgcaacttccaataatgtcatcgtcgtcatcagatgatcttgtgcatggaccatgataatttccatttctatttttgtcccactagcatattctttcagaagttgagtttgtgattgatgcgcatgaagaatctcttcatttgcttgtcgcaacttctcttctacttcttcaaacagctccttacgcatcgagcgaaatgcttcatgtatcagtgttcgtgcatttccgctatgaaaaatgatatcaaaagacgtcacttgtagcgtttcactgtttattttttcagccatctgttttcctccttattcgatcaatttgataaatttactgctgaaattctcaaaaataggttcagctaagatttcctgttgcacgtttagctggtcaactaacctaacgattgctttggtcacgaccgtaattccttcattttcgatataagaaggcgaaactagaaaaacaaaatggattccttgatactgattccattgcatccctgaaggaatcaatgcaacggctatctttgtttcgattccaactggaacagcgggatgtgggactgccactgtatcactgaatatgatttgtcccatactttcacgttgctggatctgctttcgcatttctcttatatatccttcttcttcatttatgctcagcttttgcaacaaatcatgaagaacttcttcttttttcggttcgtacgtataagtcttgaaaaacttttcagacagctgttcggtgtaaatctgctttttttgctgtagagaaaatgctggtatcggtcgatctgaggaatgataaggtatagattcaccaattacctttcgtattttatgaacatcatcttcattcaaaaaaatactgacatgtaaaactggaattttaaaaaacattgtcgaaagatcaatagaagaaataatcaagtcgattccttttaaagttgtttcattgatctcataatagccttttacatttaccactgtaatattttttccaaattcactgactacacgattctttaataattgggcactgccgtaacccgttgcacagatgatcaacgcatgcaatttatgcgtagctctttctttttccaatgccgccatgagatgcaaagccaaataggcccattcatcttcattgatggtatagtttttcaaagccggcatgttgctgaaatgcgtttttactgcttcaaaaactttgggattttcttcctttatctcttcagtcagagggttctcaatgcgaatgcctcggctcaatcgaatcatcattggtgacaaatgatcgagtagaccattgaaaagctggtgatcctctattaatgaaaaacgaaattcctgagacaatcgtttcaaaactttcgctacttcctttgatagttcctgatcatttttattttctctatgatttgacttagccataaggtgtaaagtcaaataagcaatttcttcttggggaaacgatacatctgcgattacctcaatacgttgaacaatgcgttgcgcgacttgatactctactcgatcagaaacttcttgttcgatacctagttccttgatttcaaacccttctcgtagacgtttgattcccaaagccaagtgtaaggacaaattctgtatgataaaatcagaaacttttaacttagcttctcttgtttcatcgagaatgatgatcactagctcttcaaaactgatgtctgtgaaaaagcgactttgtcctaaatattctttcaatgaattcccataatggttcccgaaaaaagtatccatgataaaatgccgtcgatttctttcttccccttcgatccatatcccttgaccatgcttagaaacaatttttagtgaataagaaatcaaccgctctttgatttcttgcatgtcctttgtcaaactagaacgactgatataaagctcttctgccaaatcatccataaaaagaatggcatcttccaaaagcagttggttcaatatatacttttgtcggtcttccgactcataaaatccttgaggctctctagcatatcccggtactatttcttgccgactcaaaaacagatcaaatgtcagtctttgtaaaatatgcagttggtaaccataacctggtttagcaatgatcttacctccgttttcttctactaactctttgatccgctgcaagtaattacggattgtccgatcagataataacaattcagaagctaaacgttgactggtgacatactccttcctgtgatcaatcaaatatctcaacagtaatttttccttctgtttcattatcatccactcctattccatcatatgttctcttcgatcacctctgctaacttctggatgcctgtagggattgggacatacgcttggaaagggatactaacaacaggctttccaacagattctcctaattttttgaatttatccaaaaacatcgtcgtttgcgggctgatcagaaataaatcaaaatcactattcttaatcatattatcgccttctgtagctgaaactgcatctacgagtatctcttctcctttttgcttaaagaaatccgttgtctttgaggccatcatcgatgatgacattcctgctgcacaaataatcaatgcttttttcataaatcaatcactccttttatttttataaaccaagcataacttgtaagcgttttctattcaaaatatatatttccgtagcattacggaaaaaatgtgtatcatctcttgaataatgaacgtagagcatttcactgatttaccgtaaaaaagatacacatggaatgatagcaatttatcatccatgtgtatcttcactttttccttatttttttattcgatctcatctaatgattcaaaccgtgtttttctcttattttgcggataagtatctcagtcaccccaatatacatgattcctaaacataccccaaggatattctcaaaaatacggatcgttactgctcctggaacaccaaataagcttgcagcgattgtcaaagcaccaaagcaattaaaaattgttttatatctataggtagaacaaatacctaaagctagtccacccaatataccgacccacgcaaacggaataaattggctgataccaataaataaagcacatccgatcaatgagccgataattctgtctactgctcgttctttgaaaccaatcgacatcaatccatagctagatacaatagaagaaaatgcaaaccctgcccacatcaatcgttgaaaagggacatattctcctgcgacaatcaaaagactgataccaaacgcatagctgagcatccaaattttttgttgcgaataaatatctttcaaaaaattctttctgaataagcttttgcctctattcttttctcgatgttttctataaaggataactgaaaaccaacaaaaaaataaaaacaataagctacctgtttgtgtaaagaaatccttgttcaacaaatctttaggtaacgaataaacaataaaaagataagaaaaaccgtacaaagaagcatttcccattttagggtcactagcagttgccagtaatatgctacttagtaaaataaaatgaatcaacacgcccatacctgaccatttgatcagttggacataaggcgctgttaatagtgagagcataacgatggctaaactaatgatcgaatgaaaaatcttataaccaaaatcaacaaaacgaatactcatcaacatacagaataaaaccacagcgtatggtttatgcgtcgattcaaacaatgttgtaatgaaaataataaaacaaatggcaaataatacgataaataatgatcgtaaaaacaatgaacaaatatacatgcgcttttcttttctagaagttgcttctcgtattttttgttttaaaataaacggatctagttgcagagactgataaaaacccacctgttgtcgtcctttcttttacttttatttctatatttttcacagtcaactatgacaggttgtaaatactatggaacatcatatggcgttgttattttcttgtcaactattttccctattcatttttttttacaaaaaaacagctgacagagattctgccaactgcttttatcaggttatttaattagcaacgatattgactaacttgtttggtaccgcaataacttttctgactgttttgccttcgatatattcttgcactgtttcattggctaatgctactttttctagctcatctttccctaagtctcggggaacattgcttttcgcacgaactttaccgtttacttggaaaacaacttctacttcgtcttccacaagtgctgcttcgtcatatgttggccatggtgcgtaagaaataccatcttcatttccaaggattgaccatagttcttcacctatgtgaggagcaatcggtgcgagtagttgaacaaatccttcgatatattcataaggcagagcgtccactttataggcttcattgataaagaccatcaattgggagattgctgtattgaaatgaagattttcatagtcttctgtcacttttttcactgtttgatggtacactttatcaagtttgccgtcattcaatgtagtgatacgatcacgcattttattgttttcatcaacgatcaagcgccatacacgatccaagaatttgcggcttccttctaagccattttcgctccaagcaatcgaagcgtctaatggtcccatgaacatttcgtacatgcgcagtgtatctgcaccgtaagtttcaaccacatcatcaggattgactacattaccgcgagattttgacattttttcgttgttttcgcctaagatcattccttgattgtatagtttttggaatggttcttttgtaggaacaacaccgatatcgtataagaatttatgccagaatcgtgcatatagtaaatgaagtaccgcatgttctgctccaccaatgtagatgtcaactggcagccaacgcttcaacttttcataatctgctagttcttttttgttatgagggtcgatataacgcaggtaataccatgagcttcctgcccattgtggcattgtattcgtttcgcgacggccttttttacctgttacaggatcaacgacattgacccactcctcaatatttgctaatggagattcaccagtaccgcttggcttgatattttttgtcttaggcaaacgtaatggtagctcttcttctgggacagctgtgactgttccgtcttcccagtggatgattgggattggttcaccccagtaacgttgacgggagaatagccagtcgcgtaagcgatagctgacttctttcttccctacgccattttcttctagccattcattcattttgtcgattgcttcttgtttgttcataccgtttaaaaattcagagttgatgtgcgtaccatcttctgtgtaagcagctttttgaacatctccaccttcgataactggaagaatctctagtccgaaagtttgagcgaattcaaagtcacgttcatcatgtgctggaacagccatgattgctcctgtgccgtaagaagctaatacataatcagcgatccagattgggatttctttgccattgactggattgattgcgtaagcaccagtaaatactcctgttttttcttttgcaagatctgttctcttcagatctgattttttagctgtctcttcgatataagcttctacagcagctttttgttcaggggtcgtaatttctctaacaagatctagttcaggtgcgagaaccgagtaagttgcaccgaataaagtatctggtcgtgtcgtaaacacggtataggatttatccgtaccagccactttaaattcaatatttgctcccactgaacgcccgatccaatttctttgcatttccttgatgctttctggccagtcaactagttctagatcatccaataagcgatcggcataagcagtgattttcagcatccattggcgcattggttttctgactacgtcatagccaccacgttcactttttccatcgatcacttcttcatttgaaataactgttcctaattcaggtacccagtttaccgctacttctgcttcataagccaggcctttttcataaagcttcgtaaagatccattgtgtccatttgtaatactctggatcagttgtattcacttcgcgattccagtcataactaaatcctaaagaattgatttggcgtcggaatgtttcgatatttttttgggtaaattcagccggatcgtttcctgtatctaacgcatattgctcagcaggtagaccgaatgcatcccaccccattggatgcagtacgttgtatccttgacttcttttcacacgggaaaggatatccgttgccgtatacccttcaggatgccctacatggagcccttgtccggatggatagggaaacatatctagtgcataaaattttggtttttcaggatcatcatgggtgttgaaggtattcgtttttgcccagtatttttgccattttttctctatttctttatgattgtaactcattttctgtcctcctgttctattaaaaacgcttgtttctattatagcgaaaaaaaccggcagaatctgtttctttttgttttcttttactttgttttctcaaacttcacaaaagaaataaaaaaatcctataaaaagattgctctttttataggacgtaatctacgcggtaccacctatttttaccttaatgaaaaggcctcgaacgttgtaacggccgtcaccgccacttgcttactcgaatattcagcaagggcaactcaaaggcgagttcaaaagcatccgtacacattctcaccaaccatgtgctctctgaaacttcagtctttttactacttccttttcaagtgttgtcatatttaagtagccttatagtaacaaatatttttgtggaattcaatcgttatttctttgaacagctattttatttagctacaatcaatgtttgacctggataaataaagttgtttttgatattgttccattcgattagttgagccattgtaataccatggctgtcagcaacaccccaaacagattctccagatttcacagtataggttttcgaacctgcaggtgcttgttggtttgttgtttgagacgaacctttcttcacgatcacttgttgtccaggatagatgaaattatttttgatattattccattcgatcaactgatccatcgtgatatgatgtttgttcgctacgctccaaactgactcgcctgctttcacggtatacatcgtattaccagaggatgatgtacttgttgtagcagacgtattcggtgtatttggtttcgctgccgaagtagttgaacctgtattggtatttactgaattgccgcctttaacgatcaattgctgtcctgggtaaataaagttgtttttgatattattccattcaatcagctgattcatcgtgatgccgtttttattcgctacgctccaaacagattcacccgccttgactgtataagtgccttgagacgaactgctgccagtattagctgagctgctgttatttgtattggctgacgaacctgtattacttgatgcgctgtttgttgacccactgtttgaaacagtcagttgttgtcctggataaataaagttattttggatgttgttccattggatcagttgagccatcgtaattccatatttgttggagacactccaaacagagtctccggctttcactgtgtatttcgttcctgaagccgtattagaagaacttgaattagacgaatttgaaccacttgtgttgccagtatttgctccagtattagaggaaccgccatttgatacgatcagctgttgtcctggataaacaaaattattcttgatattgttccattcaatcaattgagccatcgtaattccgtgatcatttgagatcttccaaacagaatcgccagattgaacagtgtatttcgccccagttgtttgtcctccgtttgatgtaccagcatttcctgaagaattggtattgttaccagaattattcgtcgaagagccattttcttggctacccttgatcgttagtttttgtcctgggtaaatgaaattgttttggatattgttccattgaatcaattgatccattgtaataccgaatttattggagattccccaaacagaatcgccagattgaacagtataagtggtcgaagttgctgaacctgagtttgtattaccagaattacttgaaccgctagtactacctgtacttccagtattattcccacctgtagtggctccaccgcccgcgtttccgctagctggtgtatcatattgggtcaatccgtaagtcgtgatgatattatttaatttgcttgcataaccagggtcagtcgcataacgacctgtcaaacaagctgtcgcatctgtataggatctcgtgttgctcttccaagtaccggcatagtaataaccgttgccaaatgaagtatttctaagtacataggcattgtcattgaacgattcagcaaaagaaggatattgtcggaaaggctcctttttatttacccattgattatttaaaaattcaagcgtatccatgtagacagtttgtccttgatagctgccttttatcccaaaaagattataataaggtgcttgcgataacgcactactgccccaaccgctttctacaactgcttgtgcgatcatcactgatgcatacaaatcgttggcttgagcaattggctgcgcataagtagcaatttctgtaataaatgccgctgtattgattcttgcgccgaactgaacaggtgtttcatccgcttgaacaggaaccggctgtactaatggagcagcgacagaacagcctaccatcgcagttcccacgattgctgcccctcgttttgcttttcgaaaacgtttggtctgttctaaacgtctccgttcttttcttgcaatgttttccatcttctatcctccaacttcaatttatctattattaataattataacttctcttaatatttattaaaagttatttaagagctttgttgttttttgtaatcatattgtaatttaccgtaatgaacaacttctgttcatttttaagttcttcctacgtctatgttcttatttacaaggatttcgaaaaacactgattttattttcctaacatttcatttgtattaccaaaaaatgtctttccgattacagttatttttttataagaatattggttattcaaagagggatcatgcatgggttttatctctttaccgtttttttcgctggaccaaaaatgctataataagtcattgcttcaaaggaggaattgtatgaaatataaaacatcatttcaagtgactggcagcttctttcttgtcctgttttttattttgggctggatcgtaaagttcaatctatcgtggctttctggtttcgatcagtggtttacagacattgtcagagcttcttatcctgatctgaacagctaccaactctttatgactaaattcggtaatcctcttaccgtcatcattttatttgcttgtacggctttatggatgtggtataagaaaaaaagggcagaaacagtttggttcgtttctggatttattgtaattgctggaatcatcaacccgttgatcaaactatttttcatgcgagagcgcccttcattgacacacttagtggttgaaacaagttacagtttccctagtggacatgcagcaggcagtatgattctttacggctctttcctatttctgctgccagcttttgttcaaaaaagaaccttacgtacattgcttcaattgctgatggtgtttattatagtaagtgtcgggataagccgcatttatctgggtgttcattttcctaccgatatcatcggcggctacttactcagtttttcttggctgtgcctgacttatccagtgtatagagaaaaaagaaaacaaataggtaactcttacagaaagaaggacttttaatgacttttccttattcagaaggaaataaaagatatcattcttggaattatgctttacgaaatgagtttggcgggaaaattttcaaggtgccgatcgatggagggttcgactgcccgaatcgagatgggactgttgcccatggcggttgtactttttgcagtgtatctggttcgggtgatatgatcgttgcacctgaagatccacttccaatccaattccagaaagaaatcgacatgatgcatcaaaaatggcctcatgtccaacaatacatcgtttatttccaaaattttacaaacacccatgcgccagttgaaataatcaaagaacgatttgagcaagtagtcaatttaccaggtgtcgtaggattatcagtcggtacacgaccggattgtctgccagatgaagtagttgattaccttgctgaactgaacgagcggatgtatttatgggtagaacttggattgcaaacaacttttgaagaaacttcaaaactgatcaaccgagcacatgattatcaaacttatttagatggcgtggctaaattacgcaaacataatatccgtgtttgtacgcatttgatcaacggattaccaggcgaaagtttagaaatgatgaaagaaaatgtcagacgcactattttagattccgatatccaaggaatcaagctccatttgatgcatctgatgcgcaaaacgagaatgttgcgagactatcatgaaggtcgacttcaattaatgagccgtcctgactatgtcaatgtcatttgcgaccagctggaaatgataccaaaagagatcatcatccatcgtttgacaggggatgcgccgtgggattccttgattggaccaatgtggagcttgaaaaaatgggaagtcttgaatgcaattgatgaagaacttcttcgcagagatagcttccaaggaaaatatgatgtacggaaaaaggtgagtgtctgatgttgcaaactgctttgtatttcagccatacattactgcaagaaatcttgcaaccaggagatcacgtcgtagatgcaacgatgggcaatggccacgatacggtttttctagcagaacacatcggaaaaactggtcatgtctatagtttcgatatccagcaacaagcaatcgatgctactcgtgaaaagctagaacagcatcagttagaagaacgtgtctcattgtttctacaaggccacgaaacgttaggagaagtaatagctgaacaacaagatctcaaagcagggatcttcaatctagggtatctcccaaaaagtgataaagcaatcatcactatgccagagactacacgcacagctatggaagaaatattgaaacgacttgtgcctcgcggacgattgatccttgttgtctactatggtcatgaaggcggagaaaaagaactggatatggttgattctttttgttccaaactgccacaggaaacatataatgtgctgaattatcggtttatcaaccaaaagaaccagccgcctattttatattgtatcgagaaaaaaagataaaaaaaacgcaaaacataaatgatatgttttgcgtttttttctctagtactcaggttagagcgttgatttcacaacctctttattcacggtgctcaaaagcttgcatctgcggtaataagtccaaccaaatcaaaaacatgagaagctgtttttgattggctgttcttattacttgatgcaggacagctttttcacaacctctttattcaaatacaaattgattatgataaagttccgcataaaatccattttctgctaatagctcgtgatgactgccttcttcaatgacttccccatcacgcaagacaacgattctatctgcattcaagatcgttttcagccggtgagcaatcacaaagctggttcttcctttgattgcttcatccattgctttttggatccttgcttctgttaccgtgtctacattacttgttgcttcatccaaaatcaataaagatggatttgtgatgatcgttcgagcaatactgatcaactgcttttgacctgtactgaacaaattgttttcttcggatatctctgtatcataccctttttctaacgtcatgataaagtcgtgaatgttcgcttgttttgctgcattgatgatttcttcatctgaagcatctggtttaccgaatgtgatattgtctttgatggtgccagagaacaagacggattcttgcaaaacgattcctacatgtctacgtaatgcatctagatcatactctcggatatctattccatcgattactactgacccatcattgacatcgtaaaaacgattcagcagattcatgatcgtcgttttcccagatccggttggtccaacaagagcaaccatttctcctttgtccacattgattgagacatctttcaagactagtttttctggagaataaccaaaatctacgtgttgcaaggcaagtccttgttctactccatcaaatgctttaccgttttctggtttgacttcatctttttcatcaaacatttcatttaatcgtcttgcccctgtaattgctaattggatcatgctgtacccagaagaaatctgcatcaatggttggtagtattgttgtgaatattggacgaatgtcacaactaagcctaacgccaccgaacgttccaaatcgccattcaatgctaaccagccgccgaaaaagataacgattgctgtattgactagtgacattccttgcatcatcggaaatagtaggccagaataagcttgtcctttgaacgttgcttcgcgaacactttgattatgttctaagaatccttcaatcgtttcttcttgtaagccatttgtgatgatgacacgttgtccgctgattttttcatccatatagccattcagttttcccacttcatcttgctgaagatccacatattttcgcgcttttcgaataatcaagacagctatcaaaatagctactggagtagaagcaatcgtagcccaagctaattctacattttgacgaaacatcataatcaagattccgacaagtaaaacagcattcgtgatgacttgaagcaatgcttggttcaaactattttgaatattatctaagtcactggtaaaacgacttaaaatttcaccatcttgatgagaatcaaagaagcgaatcgtcaatttttccaatttgttgaataaaccgatacgcattcggttcgttgactttcctactacttgagtgaataaaatactatagataaagttggctgcactagctaatacataaaacaacaagagtttccatattacagaaacaaatttgcttttatcatctacgccttgcatcaagccacctacgtaatttgctaattcttggaaagcttccccgatatactgaggtgcttttacttgtagataggtagcaataattactgtgataaagataaagaaaaaggagagtttgtaccgtttcaaatagtgatagaaaaatttacttgcttttattaaatcagtcatacttactcctccgttcctttttgagtttcaaagatttcctgatagacacggtttccagctaccaattcctcatgggttccttcgccgactaatctaccttcatccaatactaagatgcggtctgctttgacaacagaagcaattttttgtgcgatgacgatcgtcgttgttcccttcaaatctcgatcaagtgcttctcggaccagtttttcagagcgagcatccaatgcactcgtactatcatctaaaatcaagatctttggatcaccgataacaccacgagtaatggatagtcgctgcttttgtccaccagaaaaattgctgcttcgttcttctactggtgcttcgtaacgatcagatagcttttcgatgaattcttttgcttgagcaatagaagaagcatgctccatctctttttctgttgcattcttttttccttggcgcaagttttgagcaatcgttcctgagaataaaattgctttttgcaaaacaaaggacaccgtttgtcttaaactcttttcatttacttggcgaagatctacaccacctacttctacttttccttctgttggatcaaatagacgaggaatcagctgtgctagtgtggatttcccggcgccagtcgcaccgacgatcccgaccatttctccaggtttgatagaaaagctgatatctttaagcgtatctgtatcctcaccaggataacgaaaagaaacatggtcaaaagtgacagaacccgtcagctcttgttctggaacgtctaaataagtaagatctggttcagcatctaaaatttccgcaatccgcttcagcgatacggctgctcttgaagtcatcatcatcatcattccgccgataatgatcgccatcatgatctgcatcaagtaattcatgaatgaagcaattccaccaattaatgtaggatcatctttaacaagatcgctcacaaagaagatcgccccaaccacagctaaattggcagccagcatgaaggacgggatcatcacagaaaataatgtaccgactatgatgttgtgttttgttaagtcctcacttactttgctgaatgtcttcaattggttttcttcctgtacaaatgatttcactacacgaatccctagtaagttttcttttgcaatgctatttacacgatcaatcagtttttgaatgatcatgaagtgcttacccatccgtgtaaatgaaagtgccgtgataagaaataccgtaacgataagcgctacgatgatccaccacaattgtggcatcgtgatcatagctaaaatgaaggcaccaataaataagaatggaattcgaaaaagtgattgcaaagaaatcatcactaaattttggatttgcgtgatatcatttgttagacgaacaacaagattcccagcagagaactgttcgatattcccaaatgaaaatgtctggatctttcgaaaagcttcttctcggatatctgcacttacgccctgagctactttcgcagagaaaatcgtgttcgttacacctgcagctaatcctagcaaagccagactgatcagataaataccgattgttttcatttcatcattatcttctgtaataatagcttccaatacttgctgtagtaatttaggttgccataatgctgctgcaaccatgactgctacggacagcaaggaaataaaaacagctactttatattttttcgcatgtcgtaagattaatttcattcgttgattacacccctttgtttaaattgacaggactaatttaacactgtaaaattagaccgactaacaatttaccatgtttaaaaagataatgcaatacacgaggttgataaaatggaaataaagctttctcaagcaatcatcattcaggccgcctttgatatcttggctgaaacacaagctctttcgcagctttccatgcgaaacatcgcaaacagaattcacgttcaagcacctgctttatattggtatttcaaaaataaacaacagcttttgcagaaaatggctgaaacaatggaagaagaattagcgcttccagatccaactttgccctggaatgaacaattgttgcagtatatggaaaattactatgacctttacacacgttttccttgtggggcagaattagaaatcaatactgtgcccgcttttccgagtcgattagaacatttggaacaaatgatccaactacttgttcgtgaaggattttcagtcacccaaagtcatcaggccattgcctctctccacaatttattgattggacagctaatggatcagcagcatgaacaacagcttcggcaaaagattatggacggaaatgaatttttgaaagaaacagttctatttatgcgtaattatgtagttgaaaatcaattagagggatctaaagaaagtatgcagtcccatgcagaattgaatgaaaaagcactctttctaacgagtgcacaaacctatattgaaggtttatgccaacaaaataaaagaagagaaaacaattgataaaaaaagctcctataaaggtcaccaacaaagtgatctctataggagctatctttttaagtctcttttttacttttcttccatcagccacaccaatgcacgttggatccattgatcccagaagatccaattatgatcgccaggtccttgttcaaaggtgaccgctaagccttgttcctgcatagcagataccatttcctgatttgcttgataaagaaaatcagattccccacaagccatataaaaccttgggactggttttccgctttttactaattctttcaataaatattgtggatcattctttgaaccttcgatttgatccaatggtccaaagattccttcccaaaaggctgctttacgaaccatcaaaagatcatccattcggtttcctacagaaacagcgcctgaaagagagattactgctgcgaaattttctgattttgcaaggcctagttttaatgcgccatatccgcccatcgataatccagcggcatatgttttttccctttttcttgttaattgtgggaatagttcatgacaaatctcaggtagctcttctgcaatgaacgtccaatatttcatatcataaaccgtatctgtgtaccagccaagatcagtagatggcatgatgacagctaatccgtagtctgctacataacgttcaatcgacgtacgtctttcccatacactatgattgccacccatcccatgaagtaaatataaaacaggtatgtccgttgtcgcttgctctgaactggtgccaatcacctttttagttgtttgtggaagtatcacatttagattgacttccatttctaatacattcgaataaatatttgcttgaataaatgccatattttcgccttccttagtaagaagttatttttgaataactttaaatttgaatgattcggcaaagtacatgtctcgaccgaaactactgttttattttaccacttttttcatgaacgaaaagcgttaagaccaaagcaatgatcacgagtaacaagccaactagataaacggaatgtaacccatcataaagaatttttcttaatggcaatagaatatccgcatcgatatatttagccgtttgtggattcaccagtttgttcatgatatccgtatcatttgttaaatttgctgctgcaagttctcgtttagttaccccatttatcaataaaccaaaaatagaaaccatgactgtttgaccaattgttcgaactaacgtattaaaagaagttgctacaccaagctgatcacgagatacactattttgtgcactgacagtcgaggtagtcatggtcacacctaagcctataccgatgaccgttgatatagcaaaaaaccataaatagttacttctgaaaggcataagatacaaccaagcgcccccaatagctgcgattagtagtccaattctcaagacccaatgagttttcatttgagtcatccacttgcttgcaaggaaagaaccgaccatccagactagtgataatggtgctaataccaacccaccaattgctgcattcagtcctaatacaccttgcatccacataggaatataaacatcgattcccatcaaaaaaccactagccaatgctgcagccaagttgaccacaacaaatagtggatttttgaataaatacatcatgatgacaggatctttagctcttttttcggcaaaaataaaaatacctaacagtacgatactacctagcagcaaagcagaaacaagcggactcattccttcgtctcctaataattggaatcctaacagcaatgagacaagcatgaccatcaaactaaaactaccaaaaatatccattggtttagactcatgtatgatttttggttcatttaaatatagccaaataaaaataattaatagaattccgatcggcacattgataaaaaagatccagtgccagctgatcgtttcaacgatgaatcctcccgcgagcggtccaaaaacactggcaatcccccaagctgaactattcaaacctaaaacttttgctcgcttctcaatagaataaagatcgccgatgatcgtcaaagctactggcatcattgctccagcgcccatcccttgaatcgcacgagcagcaatcaacccaatcatgctttgagataaaccgcaaaataacgaaccgataataaacaataatgtcccaaaaataaaaattggttttcgtcccactttatccgcaagttttccgtaaatcggagtaagcatagcgtttgtcagcaaataaatcgaaaatacccagttcatgatttccattccatgtaatgagccgacgatcgttggcatagcggttgttacgattgttccttcaatagccgtcatgaacgttgcaatgaaaacactcactgtgactaaagcaacatttgtttcttttttcatcttattcctcctttttcatcatgacaggatctaaaaatagataaatactcactatctttttcaagaggtgcactgccataaaaaaagctggaacaaccaccattcggcgatcgttccagctgaatatagcttattttgctaaacttgctttcaatgcatctactttgtccgtatgttcccaaggcagatccacatctgtacgaccaaaatgaccgtaagcagctgtttgtttgtaaatcggacgacgcaaatcaagcatctcgatgattcctgctggccgaagatcgaagttttctctcactgcagcaatcaattcttcttccggaaccgttccagtaccgaaagtattgatggagatcgaaacaggttgagcaacaccaatcgcataagctagctgtacttctgctttgcgagcaagccctgctgcaacgatgtttttagcaatataacgtgcagcatagctggcagaacggtcaacttttgtcgcatctttaccagaaaaagcaccgccaccatgacgagcataaccgccatacgtatcaacaatgatctttcttcctgttaatccggcatccccttgaggaccaccaatgacaaatcggccagtcggattgatataatattttgtttgatcatctaataattcagctggaataacttccttcactactttttcgatgacatcatgacgaattgtttcattatctactgcatcatcatgctgtgttgaaataacgattgtatctacgcgttcaggttgtccttgatcatcatattcaactgtgacttgagattttgcatctggacgtaaatacgttaattcatttgatttacgtaaatctgccaagcggcgtaccagacgatgactcaaagcgattggtaaaggcattaattccggtgtttcatctacagcaaaaccaaacattaacccttggtcgccagcaccaatttcatctaatacgtcttttttatcttcatcccggatctcaagtgcttcgtcaactccttgagcaatatcaggagattgttcatcaatcgcaaccaatacagctgctgtatctccatcaaatccgaattttgcacgtgtataaccaatttcttttattgtttcccgtacaactttttggatatctacatatgccgtcgtagatatttctccaaatactaaaacaagcccagttgttacagatgtttcacacgctactcgtgctgttgggtcttgttctaaaattgcatccaagattgcatcactgatttggtcagcgattttatctggatgtccttcagaaacagattctgatgtaaataagtgtctttctaccattataatgattccccctagttaaattcggttacaaggcatctccgtcctacggatcctttcgggaacttgcaacgaaccaagtatagcagataaaacagttttctgctcgtattttttcatttttttgcttaaaaaatataaatattttacgttagatttatccaaaaaagcttagcacaatcatctataaagataactctgctaagccttttaaaatcattctttcagataaaaagaaaaagatactcatcaagtatcttccatgacccgtacgggattcgaacccgtgttaccgccgtgaaagggcggtgtcttaaccgcttgaccaacgggccatatgtgaataaagaaatgatgaaggcgaaagaatcacgcctgaatcattctgggcggacgatggtatctatcggacttcttttcttgaagcaactcaaggagcagagggaacggaagaggaatttaaccagttgaatgatcgtcttttcccagataaagatcatctgtatatttacctttggaacaatgaatttacgaattattataatgaaggtcgttattgggatggcgcttatgtgtggtcagtgtatgacgaaaagagaaagcgattcactgttttcgatgctaggttagtgatgatttgattttttcagactaaaaataaataaaaattttgaagaggaaggagccgcccttggcggctcctcttttacagttcttcgtaagtcaggataagcggttaggatataatactttcgttttttccatacgatgttgggcattctttgaataatcactttggcgtaatagatcgagtcgtattgaatatgagtatcctgatttaatctataaaacccccaccctaatgttttcccaagagcgattgatttatacgatcgatagattacacgattaccatcttgtaaagaacaatcacctagaggtaacttgatcgtaccctctaagtattttttattggcagtatagatcgcgaagttgataaatatcaaagcttgttccgtagtatggaaggcagcggaataggttatgtcctccaatcgtgctcgtagtgcatcctcagactgtcccacatgccgttccatcgtatgccctttcccgccgtctgcataccattcgtcatagtacaaatcaagaggggaataccattcgaattcatcgtcatcatcgtcatcccctttgaagtttttgattgcttcaaggacgcgagctagactcaatgcattccatgcagcgcccattgcgccttcgactaatgttttacctgtaccatcttctacgatgtctccagtctcttcatctaatacacctcttcgcccatcgatcgtgatcgagtcatctattgggatggctgcttcactgtaagcaaaatcgatcgctccccactggtattctggaacggctactcgagtgtcagcgtacacgaactttcctgttgcatcaaggacaaccgtttgtccgtataaggtagcgattataccagaaggatcgaagctcaatccgttttcagtcggtgccaagacttccgctaagttcttttgtatatcggcagtgcgtgtatgataggcttgcgccatttgctgagccgtctggacagcgatttctcttgagggtgtttcgatcaccccaaattcaaaagtggtgttttgctggatgtattccagaaagtcttcttgagtcgcgatctggctcatcaagacagacatcgggacacttaattcgacttcatagacgaaggaaccgttgctaccccgatggccataattgtgaccggagatcgtcagtaatgttgtatcactgccgactcgagtttccatgacacgaaccatttccagtaagaagaattgatcttcgatgaacattcgatcagctaccgaggcatcacgtccaatcacaccagtccgagccgtttcagtagaaagagaaccataagagatcagtttacggaatgccggatggtcattgatcgaaaagcgataagcaccatgatccgttgttcctgtcaaatattcccgcatcaatgcatgactggtcacgtcttgcgcgtatcttttttgcagaccttgcgagaaattataggtactagtagtggaatcaattcccgaagtggcaaaagcggccaattcttgttgcagggcaggattattggaagataattcatacaagctcgcattcgttttgagtaagtctgcagtggcgacacctaaggaagaacctaattggtaaaaactataaccaagtcctgctcctaggatagcagaaactactgcagcagaagcagggagggaaaccaatgcagaacttaatgtagcaccaacagcagaaaaaggagagagaaaagaggagaaactgacgccaccggttaaaggaaccaatgtaaaggaaccaatgctgcgttgtgcggatctggttcttgggtagtgacagggatacgagagatagacgggagttcaggaacaacttcggtcgtcgcatgttgttctgctttaatcgtatacgtttcttgggcgtgcgtttggacaggcgtggcagcaaatggcagaagtgtcaacacaacaaaaaacaaatgagtgagttttttcatgttttctcctttcaagaacacgtgcgactgatcgacaagggggtcttttgcacctccgttcattcgtattcgcttacacatttaattattcttgaaaaaacaaaagaatacaaggcgtaatagaaaaaatcaatttaaaaaaatgttttttatattattggtgtttccttcgtgtattctcatggaagacagcagttatgtcaaataatcgtttgttttggatgcataatcgttcgcgtaactgataaagaaaaagaagggatagatttatttattttaatattaatgttatttaatgttttcttttcaaacttatagaaataacatattttatgtaaaaaactgaccataggataaatggtcagcaaattcagtgatttaactaagtttcgtgctttctaagggaacgactgtctctcttttgatcaagcgatgagggatgaccaaacgtacgccgctacttaattcttcatgaatcagttcacgcagtttttgcatagcgacacgtcctaattcggagatatcgatatcgatgcttgtaaggtaaggatgtgtcaatgttgagaatatcgagttgttgaagctgatgacagaaagtgtctctggaatgacataaccatacatttgtgccaactgcatcgtgcgaagggcgaagatatcgtcaatgactaccaatgctgtggcttcgttttctttcaacgttttctcaaaggtcagataatcttctgtatgttccagtactacactggaaaacgcaggaagatcagccatcatcatcgctttttgataaccgaaatatcgttcgaaatacaaactctcatgagtcgtattcgtcacgaataggatattcttatgtccgttctgaatcaaaaattctgttgcttgtttgcctagaagctggttgtcattatctacataaacgatttcgttttcgtgatgataaggctgtccgatcaaagtgaaagggatatggttttggtataaataatcaatgacagggtcttgactatctgaatacactagaataaagccatctacttgtttttgtagatgcatacgctggacgttctctaacagtaaatcaaaatttttagcagtagcaatcgctgtcgtcatatcataattccgcgcttcttcgttgattgcttccatgatctcaagataaaagggattcccaatccgctcttttgaatcaagagggggtaagatcacgccgatggcactggaaatgcgttttcctagattgcgggcagtcatgttaggaacataacctagttcatccatgatttttcggactttcttctttgttgcttcggaaatactaggatgatcattgataacacgagagacggtcgaggtagcaacaccggattttttcgccacatcttttacagtaatagccatgataaaaacacctttctcttgttattgtgcagagaaccgataaatcgtctgactgacccgttcttgaccaggatggaggttgatcgatccaaagttgggaaaatgaacgatatcagggatttcttgcggttcgattgctaatccgtagtttgaatgcatctgttttccgttgacagagaaatcagcttcaaatccagtcgtagaaaataataccatacttttattggaagttgctatagtcatttgacgaccagaatgcttctcgaataattgtaaggaagttctggaaagcctaggatgatgcaaaagaaatacatcatctagtccagctggataacaagcaaggatttcttgcagtgttggagattttctaaagtcgatgggcaggtcttcttttttcgtccaatttccagtaggtagtttttcttgatctaattcaagtataccatctaagaagaccgttaactgatggtcatagatgtctctttttccatttcctgaaaggttgaagtaggcatgattggtcggattgcagatggtttcgaccaggctactggcagaggtcgtcatctctaactcgttttttgtcaaacggtaagtgatcgtagcagtgattggtcctggataggtagaaaattcatcttttaagtaaaagaccacgcctattgatgaaggagttttgaaaacttctacttcccaatattggaaagaccagcctttcgtgccaccgtggatatggtgtgatccgcagtttttttccaatctatgctcaccccaggaagcatctcggatccttccagctacaggtccgacagttgcgccaaaaaagcttttatctgttagaacatcttcgaaacgatcgtaagacaataaaatattttctgattttccttctttgtctggcgcgaagatttgatgcaggcgggcaccatagttgagaagaacgacttctaaatagtcgttcttcaacgtgattttctttatttcagtctctggaactggtacgacggagatttctggattatccatgttcgtgccacttttcttttaagtaatcgatcgtaagaaaagtcgtatcagggacaagcgggatctcctctccaaggtcttcagcacgtcccacgccaattggttgagcaccacttgagaggatggcttggataccggcttgcgcgtcttcgatcccgatacattcttctgcttttagtccgacagcttttgctgcaaggaggaagatatctggcgcaggttttccgtttgctgcttctgccgggtcggcaatagcgtcaaagtaaggtgtgagacccattttttcaagtaggaaaggcccatttttacttgcagaagcaagagcgatcttgattttttcttcttttaaagaatccagtaaagggacgatcccagggaagacatcttttggttcgatcgtctggatcatctctaaataataatcattttttctttttgctaattctgcaaattcttcctttgaaaaagagtgttcttttccgccataagctaaaagcaaagagagagagtcttctcggctgacgccttttagctgttcgttgaatgtgcggtcgatcgtaatgccgatttcctgaccaagcttttgccaagcacgataatggaattcggcagtatcggtaatgacgccgtctaaatcgaacaatacccctttaaacatttgcttcctcctttcttagcgttatttctaggcgatcctctaaagtgtaagactgttcatagacgaaaagttccagaggcgtaccttctaataactcgaaagtaacttgttcatctgtaactgagatgaataataaacgtccgcgataattgatatggaaagaataagcattccaggtttttggcagaaatggtgcgaatttcaattgatcatgggcggttttcatttgagcgaatccttggacgatcgacaaccagctgccagtcatggaagtgatgtgcaagccgtcttctgtgtcgttattgtaattatccaaatccaagcgagctgttcgttggtacatttctacagctttgttttccattcctaattctgctgctaaaatcgaatggatacttggtgaaagggaagactcatggacagtcattggttcatagaaatcaaagtttttttgtttttcttcttttgtaaaagtatcgttgaagaaataaatcccctgtaatacatctgcctgcttgatgaagcaagatctaaggattttgtcccaagaccaatgctggttcagaggaagatcgcttgtgggaatatcggatacaggcatgagatctttatctaagaatgtgtcatgctggacaaaaatacctaattcttcgtccactgggaagtacatgttctctgcgatatctttccatttggctagttcttcttcgctgatagcgatagcagcttcttcttgataagttaaataattttctcgcgtgtaacgcaagacccaagctgcgatcgtatttgtataccaattgttattgatgttgttttcatattcatttggtccagtcactccgtggatcatgtatttatttgctcgttttgaaaaatggacacggtctgcccagaagcgggcgatttctgctaaaacttccagaccttcatttttcaaatattccgtatcaccggtgtaattcgtgtaattgtagattgcataggcgattgcaccatttcggtggatctcctcgaaagtgatttcccactcgttatgacattcgacgccagtgaaggtgaccataggataaagcgcgcctttcaatccttgctgctgagcgttgtggatcgcttgcggcagctggttatgccggtatttcagaagattcttagttacctcgggtttggctaaagcgagataaagagggactgcatacgcttctgtatcccagtaagtggcaccgccgtatttttctcctgtgaatcctttaggtccgatattcaatcgttcatcttcgccgtagtaagtagagaatagttggaacaaattgaaccgaataccttgctgtgcttcttcgtctccttcgatgaccacatcggcaagcttccatcgttctgcccaagccgctgtttgttcttcttttgcttggatataattgtttgtctgatttgctaattctgagacggctttttctgcttgctgcgcttctgggatatctcgactagtaagaacgatgatttctttctctactgtccatgtctcgccttgagataattcagcagacaggcaaccatgtaaggctaaagtatcttcgtgatagtcaggaacgactgcttttccgttaacgaaatgacgcattgctgcagtaacagtgaattgttcgatcccgaagttgtttggaatagttttggttgtcaaatagccgatttcttctatggttccacgatcgatctcattccaaaaatgttcatcatagttgctgtcttcgttttggacatttccatccaatttcgatacgaggtcgactgttccattaccttcaagcatttctatagtcaaatggatgtaagccgcttcttttttgacaatgcttaaaaaacgttcaaaggagatacgtactttattagtagaagtagtgattgtgaacgtacgagatagcacaccatttttcatatctagttcccagtaaaagtcttctggttccaaagaagccaagtcgatcagctgattgttgatcgaaatatctattgcgataaagttcaaggcattgattacttttccaaagtactctggataaccgtttttccaccagccgacacgtgtcttatcaggataccagacacctgccaaataagtaccttgatggtggtcccctgagtaagtttcttcaaagttcccacgcatccccatataaccgtttccaatacttgtcaaagattcttgcagtcgaagattttttttatctaattgggtcgtgctgattttccatggatcaatagcaaatagtcgtttgatctgtttcattgttctcctcctaatgagctgttttatacgttcataataaacgcaaccgattgcgcaagtcaatagacaataggaaatatttcatagaaaaaagcataaaaataaaattttttcgagctatttatagaaggaaacttatgtattatgggttttgtagaatggtatagacagaagaataaaaaataaagcatttacaaaaaagaaaacgcacgctataatacatttaacgaaaccgattgcgtaaaggagctaaacggaatgaaaaagatatttagttttgagttttggcaaaaatttggaaaggctttaatggttgtggtggcagtgatgccggcagctggattgatgatcagtatagggaaatcaattcctttgatcaatcctgagtggacgccgcttgttacaacgggcggagtaatagaaaatattggttgggcaattattgggaatcttcatattttatttgctttagcaataggaggaagttgggcaaaagaacgggcaggtggggcatttgctgctgggatctcatttattttgatcaatcggatcactggggccatctttggggtcacaagcgatatgcttgcgaatgaagatgcgtttactcacactcttttcggtacgaagatcatggttaaagggttctttacaagtgtgttggaagcaccagctttgaatatgggtgtatttgtagggatcatcgctggttttgtcggggcaatggcttataataagtactataattatagaaaattaccggatgctttgtctttcttcaatggaaagcgctttgttccgtttgtcgttatcttatggtcaacgattgtggcattgattcttgctgttgtttggccaaacgtacaggccggaatcaataattttggtttatggattgcagaatcacaggaaagcgcaccgattctagcaccgtttttatttggtacattggaacgtttgctattaccgttcggattgcatcatatgctgacaattcctatcaactatacacagcttggcggatcgtacgagattttatcaggcgcacaggcaggaacacaagtttttggacaagatccgttatggttagcttgggccactgatttagtgaatcttagaggtgcaggggatatgtcgcaatatgaatttgtgttgcataactggacacctgctcgtttcaaagtaggacaaatgattggttcttcgggtattttgatggggatggcatttgcgatgtaccgtaatgtcgatcctgataagaaagcaagatataaatcaatgtatttttcagcagcgttagctgtctttctaacaggtgtaacagaaccattggagttcatgttcatgtttgcggctgtaccattatatgccatttattcagtcattcagggagctgcatttgcgatggcagacattttaccattgcgggtccattcatttggaaatatcgaattgctgacgcggacaccattagctatcaaagcgggtctaggtgcagatcttatcaacttcgtgttatgtgtgatcgtttttggtgttgttacgtatttcttagcaaatttcttgatcaaaaaattcaattttgctacacctgggcgtaacggaaattatgacaatgacagtgaagaaaccactgtatctaacagtggaacaggaactgcagaccagcaagtggtgcagatcatccatttgttgggaggaaaagaaaatatcaaagatgtcgatgcctgtatgactcgtttacgtgtaagtgtaaacgatcgggaaaaagttgggactgaagaagcctggaaacgagcaggagcaatgggactgatcgtcaaagacaatggagtccaagcagtttatggaccaaaagcagatgtcttgaaatcagatatcgaagatctgctgcaatcaggagcagagattccagagccgcaaatggtttctacaggaaatggacaagcagatagtaagcattacttaggtatagaacaagaactagtttccgcagcttctggggaagtgattcctttagctgaagtaaaagatccagtattctcacaaaaaatgatgggtgatggttttgctgttattccaacgtcaagagaagttgttgcgccgatcgctggaaaagtgacaagtattttccctagcaaacatgcaattgggctagaaacgaaagagggcgtcgaagttttgatccatatggggattgatacagtccaaatgaatcagtcagcttttgagattgctgtcaaagaaggacaagaagtaggaacaggatcgaaattagctgaaatgaatcttgaagtgatccaaaacgaagaaaaagatccaacgatcatgatcgtatttacgaatgataaagtggaagaagtagtgatcaagcaattagggacagtggcagctggtaaagtgatcggctccattaaaatataaagggaggttgtgaaatcagcgccctgacctgagtattagagagacaaaacggaaaaatagctcctcatattttgccgtttttgagctaataccgaaggtcagctgattgaacactgtttactggggaggttgtgacaaaattttgtcacaaccccttttgtttcgaaatgaagagaaggagaagaaccatgaaattcatgacattgaacacacatagctggcttgagccagaaccagagaaaaaattacaggaattagcagagaagatcctgttagaagattatgaagtgatcgctttgcaagaaatcaaccaattactggaatctgaagaagcagaccctgcaaaactaatgaagttctgtccagtagagaatcaagttcctatccgcaaagataattttgcctactgtttagtccagcttttaaaagaacaaggaaaagagtatttttggagttgggaaatgagccacatcggttatgataaatatgaagaaggaaatgcgctgcttgcgaaaagaccattggaaagtcaggtcctcaccgtctccgaatctcaaaagaaagaagattatcggacgcgcaagatcttgattgggaaaacaaagatagatgatcaagatatttttgtctctagttgccacttttcttggtggacagataaaaaaagcggcttttattttgagtggaaaaacttggaaaactacttttttgaaacccgcgcaccactttttttcctaggtgatttcaataatccggcagattctgaaggttatcatatagtaaaggaaagtggtcttcttcttcaagattcgtatgttatcgcgaatgaaaaaggcaaagctgctactgtggaaaagaagattgatggttgggaacaaaacacagaaaaattgcgtatagatttcatttttgtccctgaaggagtacaagtaaaaaaatatcaacggatttttgacggggtcgatagtccaatcatcagtgatcactatggggctgaaatcgaaatagatggacgatgaacgaacaaaaatatgacataaaaaactaaacaaaataaaactctccgatcgatcctaccgttcggagagtttttttttgattggatgtatcatccgttttgactaagcatgtagatgcttgtatctatgataaataaataagcacagcaaggtaaaccaaccaatcaaagtaagagaaagaatgaaatagaaatagatcggcgttcgataatgaagcgtgagctcgttgatccctttttgctgattcacgattggggtcccgatatccgttaattcataatcagtcaatgtttttccattttgctgtagtacagtccgatcataaacgataacagggatatgaaccgttttgtccccagtatttttccacttgattgtcaaaagaccgcctggatgtgtttttatgaaagttgtttcgttttctaatatttcttcgttatatcggtcgtatttgttgtcttttgtctccttatagattggcagatagtcaggggtggttttttggaaaacgaataagctggtagacatatctttgctgaagaatgttttccttgcttcttccggtgtatcgaatagataagtatgtcgactgacaaatgtttcattctcccacttttctagatgctggtataagttttggatcgtctgtgcagaaaaaataagaatacccaatatacctaaaagacggaaccacttttgctcagaccattgatttagtgatagggaaaggtaaagcagaagcaatagcgtaaatgggacgaaaaatcgaaatggaaactgaattaagctaataaaaggcacatttttttcgatcaatgtcgtccatggaatcaagctagtagaaagaaaaaagaaaacaagacttgtatacaacacgattttttggaacaaggtattcttttgttgaaagaaaataaaaagcaaaaaacctgacaatatcaatatcggaaaggctttaggataatgaagccaataactgccatccaggtcgatcgccttttgactcatttctctgttaacaaagggaggaagaatcttattcccgctgtaaacaatagccagtcctgcccaaatatttgctgtcaggacaaaataaagcaagaccgacttgatcagttgaagcagtgcttttcctttttcagtctggttaaaaaagtaataaagataaaaaggaatatacatcaaggctaacatgatcgaagacagtagatgaatctgcgtcataagtccaactgagatcgcaactttgattacaggaaactttttatgaaggacgaaatcaacaatagggatcatgcataaaggatagaaacaagtcccccaactagtgaatccttgattgatagaccaatattgaatagaatacgtactcatgaataaaacggctactggtacacttacccagttccgaacattgacatatcttagtaagatcagcatagaaaatcctgaaataagataaagaataaaatttgaaagaatctgatagtgaaaccaactacctgcaagcaacacaatcaatccttgtaaataagcaaaaaatgggccgtaaacggcattaacgatcctaccgctttgctggaatccataaagggaaggaaaatagtggaaatccccatgtttgatttgttgcgcagcatcgtagaaccgattgtaatggaagggggcatcagcacccaaaattagtttatgtgtgaataaatgaggcatgagaaatgccaaagcaatgaaaaaaattgctaaaaacgggccatattttttcaattgtcgaactcctttgcaaactttagataaattcatcatatatcctatgcggtagggaggcaagaaattagaaaattcatgaaaatatttatgaattttacaagaaaaacataagtgaaatttctaaggagagaggatgtggcaaagccatgtcgcattccttgttttgagtcaaaattttcttaatactcgaaacaaagtagctttttcacaatctcatcggctttcattttctatttttttcctgaacccatataataaaagaaagaacaaaaaaacttgcaagggaggacgcatgtgaagcagagaaagcaaaaacagtctcgtcggcttttgtttcgtttatttttattgatatgtatcgtcgtagggttactaatcgctttgtatccattttatgtggattctttaaatagtcttatggatcaaaaacgaatggaacaagtacaaaaacgaaccgcagccgaaaatgaagcgcagcgaaagaaaatggaggagcaaaaccaacgattaactgaccaaggattcaatcctggggctgatcctttcgatgaacagaacagaaatgaaagcacgacatccagccaattagaggaatggctgattggaagtgtcaatatacctaaaatccaaataaatatttcactttatgaccggcttaacggcatgattcttgagaatggagcaggcgtcttacaaggaacttctttcccacttggtggaaattcgacgcattcagtgatttctgctcacagcgggttacccaatcgacgattatttaccgagttagatcgtttagaacacggagatacgtttattttgactgtttttggggagaaattggcttatcaagttgaaaatatacaagtggtactgccagatgacacgtctgttctaacgattgaagaaggaaaagacttagttaccttgcttacatgtacaccgtatatgatcaacacgcatcgtttgctagtgacgggacatcggattccttatagtgaatcggtaaaaaacgaagaagaaaaaggaaatcaggaaagaactttgcgacagttgcttattcttgcaggaacgataatagctgtagttatactgttactgtttattggtcgactgatttatcagtatcggttaagtaaaaaagtgcttgatttttcatttattataagtgattcagcaggaaatccagtaaagggtggctcatttattttgaaacataagaaaaaaacacttactagaaacggtgtgccgttttcagtgcaaagcgatcattatgggaaagtcaagctggatcaattgcctggtgggacttatcgaatcgtgtcagttgatgatcctaaagtcgctgcttcttttggtatcagaaaattaaaacaagaaaagatgtacttttttgaggggcgaaaactggtgaaagagcttcaaaaaaatggtttttggtttaaactcaatgactaagtaaggagagaaaaaatgattcgtacaacaacagaattgtctgctgaagaactggaaactgttctatcgatttggctgcatgctaatttggattctcatggattcatctcaccaacttattgggagagtcaaatagaatctgttaggaaagctttgccagaggcagtgatttacttagcagaaatagatcaagaaatcgtcggttttgctggggtgattgatcagttcatcgcagggatttttgtaaagagggaatatcggcaacaaaaaatcggtacgcaactaatgaaaaaaataaaagaaaccaataaaacactgactttgacagtctatcaaaaaagtcaatcagctattcatttctatctttcacaaggctttgcaattcaaatactgcaaaaagatgaagcagtaaatgaggaggagcttgtgatgcaatggaatcaaaccaatgatttttgatgaacagagtaacgaaataatgctcccagcctaatttttgctgggagcattatttcattttgaagtcactaatttaactgtgtgaagatgcagttgttacgacctttgataaacggtgttcaaagcttgcatctgcggtaataagtccaaccaatttaaaaacataaggaactgtttttacttggctgttcttattacttgatgcagaacagctttttcacaacctctccactaaacggtgttcaatcagctgatcctcggtattcgctcaacaaacggcaaaatatgaggaactatttttccatttgtttctctaatactcaggtcaaaacgctgatttcacaacctcttgataaacggtgttcaatcagctgcttctcggtaataagcccactagcctagaaaatatgaaaagctattttctgactagcgttcttattactcaaagcgtaacgctgatttcacaacctctctttcacaaccttattttactcgtttataattttcatcgaagtattttccgctacggatatcatcaggcatgccatcatatggcgcttcactaatgacatcttcattgtctatacctgcatcacccatataagtgatggtagcaaattcaggaacaagtaattttggataagtttcatatttttcacgagctgcttccatttctgcgatatgttcattttggaaagtaacagtgatttctggatgttcttcaacccatttagggaaaaagatcattccgtgaagtttcttttcatttggcataaagtctaatgcaacgtctgtccctgttggttctgtccaagtaattttgaatacgccatctgtcaatttaacgatatcagcttcttggtcttttacccaacgacctttgaccattccgccgtggatacggtaatcgacagtatggtcattttttgcataccattcatattcccaaccgttgtcatacgtataaataaagtgagttccaataaaatcttccaattctttaaattctttcatgattaagcatctccctctaaattaaaacatgtaataaactacatgtttttgattactcgtttatgatagaatggatttaaagatttgtcaaggaggaaaaactgatggcaagaaaaaatacacttcgctatattttattagggttattaagtaagaagcagatgacaggatatgaattgaatcaatcattcaaaaatgaaataggagaattttggcaagcaaaacatagtcagatttatcctgagctggcaaaaatggaagagcaaggaatcattcaacatcaagtagagatcacaggcgaaaaattggaaaaaaaagtttatgaattaacagaagaagggaaggaacaattagcagagtggattcatacaccgaccaatgaactgccggttaatcgagacgaattcgttttaaaattgtatttcgtcaaagacgtgaatgatccggcattagtagaaattatccagcagcagcgtgatcttcatgaagaaaaacgccttcatctattagagcgaaaaaaaacaatctttcctacagaaaaagaaaaacatgaaaattacggacattacttgattttagcgcatgcgatcaatcgggaaacagaatatgcaagttggctgacagatgtattggaagaagaaaacaaccgaaaaaaataaactaaaaaatatccgaacagtgatggatgcttcctttctatatgaaagaaatgcagatcaccgttcggatattcttatgttcaaacaggctttttctaagtgttatatgtatcatctactttttaaaaagtctgatgtttaggagattagcggagcttagagttcttttaacagctgctcgtagtcagctttttcatcgacaggaaggagtttgtaagacaattcgtctgtctcgttgtcatgaatgatgtacatcttcgcattctcttctttgaagttgccaatttgtaaaatcgtatagcgttcgtcgatcaattcgatatctttgattgcttttgaaaaaactttgcggacatgatgcattttcttttgtcggatttctgccttttctgcagctttagataaggtaaatccgtcatctaagtattttttgatcagttctacttttataactgtaggcaaacgatattttctaggacaattcgcatcagcttcgattgaacgaatgaatcccttttgttcccaataccttaattgacgtggagacacaccgacgatatcacttaattcactgatgccaacaaccaattgatcgttttccaacaaacgtttaagggaagccccaaccatttttgtcactccttttgtcctcttactttccttaattatatctgtattaactaatgtgtcaagtaggttgacaaatggcggatttaggactaaagtattctagtagtttcagaaaaaattcagaaagaaggagaaatatgagtaacaaccaacccgtagatatttacggaaaaccatataatcggacacttttagttgttgtcttattaattggtacattttgtaccgttttgaatcagaccttattgacgacagcttttcctacattgatgaaagctttcgatatttcagcatctgatgtgcaatggttaacgactggtttcttgctagtcaacgggatcatgatcccaataacagcatggctgatcaataaattcagttcaagaaatttatatctttctgccatgacgatctttttgatcggaacgattacttgttttacagcacctaattttagtacattactaatcggtcgcttgatccaagcttgcggtgtgggagtatcgatgccattattgcaaaatatcatgttgtctattttcccaccagaaaaaagaggatcagcaatggggatgtcaggaatcgttattgggcttgctcctgctttaggccctacattatctggttacatcattgataactaccattggcgtgacttgtttggtatggtactgccaatcgttgttcttgtcttggttttagcattcttcctaatgaaaagtgttattccattgtcaaatcctagcattgatattttatcagctattttgtcaacgattggattcggtagtttgctttacggattttctagtgtaggtgatgatggctggggaagcttgaaagtaattggtttcttagtcgttggtgtgattttcatcgccttgttctcatggcgtcaattacatttggaacatccattcttggagcttcgtgtattcaaatcatctacatttacgattgcagctgttttagccggtgtaacgaatatggcgatggtaggggcagaaatggtcgtgccgttgtatatccaaaacattcgcggagaatcagcattccattctggcttgatgttgttgccaggtgctttgatcatgggggctatgatgcccgttacaggtgcgattttcgataaatacggcgcgaaacgtttagccattacagggatgttcattttgacagccgcaactgcaccatttgctttcttgacaaaaacgactccagttttatatatcgtgatcctttatgcgatccgtatgtttgggatctccatggtcatgatgccggtaacgacttctggtatgaatgcattgccaaataacttgatcagtcacgggacagcggtaaataatacattccgtcaaattgcaagctcgatcggtacagctattttgatcagtgtgttgacgaatgtgacaaaagcaaatatcccaagcaaatctgtattggacaatacaccattagcttataaagatcaggcaatcaatgccacactgtcaggttaccatgccgcgtttatcgtagcgatcatctttgggatccttggctttattattgcctttttattgaagaaaaaagaacctgttctaacgaaagcgggggataatgcatgattattggagttttgattgtcagcttgcttgcttttgctttaacgaacgtgttcgctaaaaaaacatggcaaacctttttatctttgattttcggactaatcttcgtcgcttcactaagtttgatcgtcgctaatttgtccaatcactttggaatggaaaaagtaacggaaacgaaaacagaaaaaattgtttccagtgctgattcccaaggagcagatatgcttttgtataaagctttagggaatggaaaagaaaaagtgtatctttaccgaacgaatgaaaaacaagagaaaccaaaagtaactggtacggataacgaaacaaataaagtagaaaagacagacggcgatgctgaaaaagtgacgaaaactacttattgggaatacaaaaacgacatgtataaattctggttcaatattgctgataacaatcacgaatatgacagccgagtgaatacattcaaaatcccagagacatgggtagaattaagtacggaccaagcatccaagttagctgaattagtgaagaaacagcaaagtacgatggaaagtgaagcaaaagcttatgtgcaagacggtatggtaaaagcaatgactgaaaatccgcaaatgagcaaagcagaacaagaacaacgtacgaaagccttaactgctgaattccaacaacaagcattcgcgaaattagtgaaagaagcaaaaggcgaataatattttgaacaccgtttaaggaagaggttgtgaaatcagtgttttgacctgagtattagagaaaaaaacggaaaaatagctcctcatattttgccgttttttgagctaatgccgagggtcagctgattgaacaccgtttattcaaaaaaagggaactgcgacaagacttttgtcacagttccttctttttttgctatgctatactagatgtaaaaaataggaggaataaaatgaggaaaacttattcttttgaatcaaaaatctatgcttccgaagtcggcaagggtggcgcatatattgtttttccatatgacataagagaagaattcggtgctggaagagtgaaagtccaagcaacttttgataatgtgccgtacgaaggcagtatcgtgaatatgggcgtgaaaaatttagatggttcggtctgctatatccttggactacgaaaagatattcgtaaaaacatcggaaaagatattggtgatatcgtagcagttacagtgaagcaaaaataaaaacaagaggttatgacaaaagatgtgtcacaacctcttctttcataatggtttttcaccatctttataataaacgggttctttgatatggaaatctgttttttccaaccaatctaaaatcttgtaacctaactcttctgacatcggaaaagaagcgttgatttgtgcattggagatatggtcaacatggataccggaagtgatcgtacagcttcctggtacggcatttttgatgaccacagctattttttcggctaagacatcgtctttgtggaaacgaccatcgtggctagggaaacgtacagtttggatctctgtatcacgagaaaatgtagtgactgttccgatatgtggtgtatctccgcctgttaaagtaatcaataagtctttaccgattactttaacagcagcttggatcgtgaaacctagttttgttacttcaactatcgtttctttttccatattaatcaccttgccaacgttttgaatgttcatttacaatcccaaattgatccaaaagtttcattgtatggtgatcaacaagatcttggatcgtttgaggctgattataaaaagcagggatcggtggtatgatttgcacacctagtcgtgctaatttagtcaagttttccaagtgaatggcatttaatggcgtttcacgagggacaattactaactttcgttgctccttcattgttacatcagcagcacgtgcaatcaggttgtcgcctaaaccaacagagatacctgcgactgttttcatacttgccggtacgatgatcattccatcggtcaaaaatgatccgctggcgacagcagcacctagatctttgtttgaataatggtaatcaaacaggctttcgaattcatttagggataagtcggattccagctttaagttctgttttgcccatggactgatgattccgtgtgtttctaccatcggatattcttttagtttcttcactaggttgatggcataaatggtgcccgaagcgccacttacaccaatcacgatttttttcttccgttgtgccaattgttccattttccgcactcctttttatgatgtcaaaacagttgcagatcattcattatttcaaatatttttcccaatcttctacttcttggaattttgcacgtacaaaatgttctttcatatcgaaaggaactgtaccgtcaaagatagtttttgcactcatcccacggaaacgaatagaaccaggattatattctggtaattctgatgggtccaatggatggtttctcattcctgggagcacaataatgtctttatctccttggaaacgagtgttgaaagtccaaactacatcgttcatgtcgaaaatatcaacatcttcatcgactaaaatgactgtcttcaattctttgaaggctgataaggcaagaatagctgcttggcgttgaataccttcatccgcttcgttttctttacgaatctgcatgatggtcatcaatttaccgccacctgcaggaggattgtagacatttactacttttcctggaatagctttatcaaccaaggcaagaatacttgcttctgtaggaataccggccatagatacgtgttcttcacttggaccaattgttgtttgcatgattggattgtcttttcgatgagtaactgctttgacttttactacttgtacagctggattagcatccccagtataaccaggaaattctggcattgctttccctgagttcgtgttgatatcttcttgcattgtttcatttggcatgatttctgcttcaatgatgaattcagcacgagcaatacccacttcatcgactgctacaccatcaacgatttgaataggttcgttacgcaaagctcctgcacaccatagttcgttgtagccaagtggagtggtaggtggttcgaaagtcgtaccaatggcaattgctggatctaaaccaatattgatagtgataggcattggtttattcaatgcttcaaattgtttttggaagtgaccaatgtggcgcccaccaggcatgatgtacataccgatcgtatctttgtcttctaggaccatacgatggatcgttacatcgctcattgttttttctggatctgatcctaagactacacccatcgtgatgtatggacctgcatcttcaggagtatttgtaggtgcaggcaaaatgttgcgaatatcgaagtctgcatcggtagctagatgaacgacttcttgtgctggagcgtctgctttgtctactttcacaggtttgattggattttctacagcgtctttcaagaaacggccaagtgttcgataatcatggtgcaaaatttcacctacacgtttacgactagccattgtcccgatgttcacacgtgtgccggggaaacctttgatattgttgaaagtcatagctggtccttcttgagtcggacgttttactgtaccgccagcaccgatataacggtaaacaccagataattctgcttcaggatcgatttcaatatctgtttcgtgatattgacctggaagtgtctttagttcttcgatgacttttcttaaatcatacggttgatctgtcatgaaaaattcctccttagttgtctttacctatctatagtaaaaggtacaaaggaggaaaacaattcaacttgtttgataaaatattccttaatggaatggatacggttttttgataatagaataaattatgatatacttacaacaataagaaagcgcatactaaatgctaatggaaggaaagtgaaaaaaatggaggagtcatttcctaaagcagtaaaagtagaaaatatagcgaatattttgaaagttacatttgaaaacggggaagtaaaatacgtgaaatctcattggacagaagagataaccgatgccttgcaatttggaaaaaaaggaagaggaaaaagaaaaaatcttctcgctttgtctactaatatgtggattgggactgaagtaacgattgaagcagatggaacagtattcataaatggaaaagacaaatatacaccgcaagaactgtggctcaaaggggaaaaccatattccagaattataaataggcaagaggttgtgacagaagtggtcagcttcaagaaataagaaggaatatacgaaaattgcttctcaaatttttgtgacatttcggcttatttccgaagaagctacttcaggaacaccgtgaatcagaggttgtgaccgaggagttggaaggagaacgccgtttatcgagaggttatgaaaagctgtttattcaaaaaaagggtggtgacaacaattttgtcaccaccctttgtagtaattggaaaaaacgaatagctttattctgcacgcaaagcgatagcagcgtcttttttcgctgccattcgtgcaggaagatgaccgccaagcatcgtcaatacagtagagacaatcactagaatgatcgcatggacaggatttagttgcgcaacattttttagatccgtcatgctgtacaagatgctattgatagggaatgtagctagccaggcaataaacacacctagtatcccagaagaaatacctaaaatacacgtttctgcgtcaaatacgcgagtgatgtcttttttccgtgcacctaaagcttttagtacaccgatttcttttgtccgttcaatcacagatgtataagtaatgatactgatcatgatcatacttgttactaaagagatccctgcaaaagcaatgaggacataagtgatagcatccatcaatccgccagtcagttcagtcatcgttccagctaaatcagtataaatgattttatcttcatctgatttgcctgtattgtaatcatctaaataatccaagattttttctttgtcttcaaaattgttcggataaatcatgatacttgaaggcaagctgtctccgcctaaataactaagcaatgtttgtttggcgttttcgtcaactttttcagtagttaagacatttacatcactgtctttttgggctttgacgatttctgattctttgttctcattgacgatttgagtcgttaattgatcactataagcgattcctggcgataagagattcattgtagaagaagacttcacgcgtaggattcctgaaatcttcaattcatctgaagaattctggtacatcgagtcataatctgtattaggaatgaaattcccagttggaagttttgtatagtaagtattgttgtttactaacttgaatgttgtatcgacgatatcatcgaaatcaagtttttcgtcttccttcacatcaaatccaagattcttcaatgcgttgatattagtattattgttgccgtctacgatcagcacgacatctgttgctgaggctggataacttccggcaagtaaagaataattgtcttttaaaaagttttctttgctagtgtcaagctgtgtagggaaacttgacactcccacacctgtcattgctgacatcgtactagacaaggaaagagattccgcatcagggttttgattcgagaaacttacaggctgtactttcccatttacatcacgtaaaagattgattcctgttgtacgagtaaacccaatattattacttaaattaggatcgatgtctgttacataatcgacatatgtttgatcgattttattcgtatgctgtgctttgtcttcttcgctgacttttgctgtgatcgttttgctgtctggataatctgctttgcttgcgcccaatccagcatcgtcacgggtctggttagtcgttaccttagaaatagtgatcggaaatttcgccattgtttcagcttgcgtgttatcgatttgcttttggaaaccagaagaaagggaaaggacgatcgcgattccgatgatcccgatactggaagcaaaggaagtcaagaaagtacgtcctttttttgttcggatattgttgaaagaaagcttcaacgctgtccaaaaactcatcttcgttctgcgtaggttaaattgatcatcctttggtcgttcgatgtgaggatgggaatccgttaagatcttaccatcagaaaattcaatgatccggtctgcatattgattggccagttcaggattatgtgtgaccatgatcactaatttctctttcgataactcttggatcagttccatgatctggatacttgtttctgtatctaaagctccggttggttcatcacacaaaaggatatctggatcattggctagcgctcgagcgattgctacccgctgcatttgtccaccagatagctgatttggttttttgtgcatatgatctgtcaagccgacccgatgcaaggcatcttctgcccgttttcgtttttcgtctttagaaacaccacttaatgtcatcccaagttcaacattttcaataatgcctaaatgaccaatcaagttataactttggaaaatgaacccgatagaattgtttcggtaggcatcccagtcgttgtctttgaagtctttagtagactttccgttgatcaccatatcaccggaatcataattatctagtccaccaatcacattcagcatagtcgttttaccagaaccactaggacctaaaatcgctacgaattctttttgtctgaaagcgacagatacaccatccaatgctttagtggtggtttcgccgactttataatatttttttatatcttttaattgaagcataatcacccttctcccgtagtgaaatattcggtatactaataagtatatcagaacaatgatcgtagtatacaaaataaatgttaactgaagatgaactgcaagaaaaaatctagaaatttttcaaaaaacagagggagaacaatgaatcgtattttaatagtagaagatgatccgcaattacagttgctttaccgttctgtgttggaacgagcgggcttttcagtcatcactgcactgaatggagaggatgcgctgaaaaaactagaagcgatacgtatagaattgatcattacagatatcatgatgccgaaaatggatggctatgacttgctagactcattacgtagcaccagatttgacacacctgttctgatgattacggcaaaggccgattttgaggataagaaacgcgggttcaaactaggagcagatgattatatgacaaaacccatcgatgtcaatgagatgatcctacgtgtggaagcattgcttcgacgttcaaaaatcaattacagcagtagcttgatgattggacaaacaaaattagagctggatacttatacagtgttacaagatcagcattcgttgattctgcctcaaaaagaatttctgcttctgtataaattactgtcttatcccaacaagatcttcactcgccaacagttgatggatgacatttggggattagatacgaatacagaagaacgaacgatcgatgtacatatcaaacgtttaaggacccgttttgaaaagacggaagattttcaaatcatgacagtacggggactaggctataaggcggttatttaaagatgaaaaaaaagctattttcacaattatggatctattttgccagtattgtcttcatttcgatcttagtgacactgctgtgttttctcggttttattttcttattgtctcggcattctatctcacctgctgaatcggctggaaaaccaacgctatacccgttattcgtctttgcagggttcagtatgatcgtgggtacaggaatatcgatttttgttgggcggcgtattctgcatccaatcagtgcactagggacaaatatgagtctggtagcaacgggagatttttcgattcgaatggatgagcagcagaaagtagcagaagtacagcaactgtataaagatttcaatgttatggtccaagaactaaatagtatcgaaacattgaggaatgattttgtgtccagtgtatcccatgaattcaaaacaccattagcaacgatccaaggatatgtacaattgttacaagccccaaatctctctgacgaagaatgccaaatatttttatatcggattatcgaaagtatcacgcagctttcacaattaacagagaatatcttaaaattgaacaaactggaaaaccaacgtatccaactggaaaaaaaagagtaccgattagatgaacaaattcgagaagtaatcgtttttttgcagcctaaatgggagaaagaacagctagaattggatatcgaactggctgcagtaaattacacaggcaatgaagagtttttgtaccaagtgtggttgaatatcatggataacgccataaagtacaatcaagtcaatggacagattcatatcaaactatttgagacagccacagagattgtactggaagtgaccgattcaggtgtaggaatgaatgaagagaccagagatcgaatgtttgaaaaattttatcaaggagatacaagccgtcaaatttctgggaatgggctaggactttcactggtcaaaaaaattctagaactgcatgatggtcgtattgattatagcagtatcgaaggagtaggaacgacagcaatgatacggttaagtaaacaataggaaaaagaataaaaccccctaaaaattcgattgaaggtttttagggggggagtcgtttttttgtgattagggaaatgttcttacggttctttcgacataaaatcgctgctttcttattgaactacgagaaatgatagatgtgtcattgaaacaaggatatgatgcaaaaaagagagcgaaagtcatgagtcgctctcttttttggatggattgatagacagaaaatgaagggcctagttctcttcttgtttcaaatactcccaaaatgtgtctgaagccaaagaatgttcaccgattttacgcgtaaatgcgagataactttcttttgttggagagatggggaggatcacagtattttcttttaacagatttttgactgttttttccataacaatagcaatccccatgtcatttgcaatcatattgatgatcaagtcggtcctagatcctttataagagattctcggttcaaatccagcttcgcgacacaagtccagcacaggttgatacaagttcgtagtagggccaagaaccaaaaaattctcctttttcagttcacttagatccaatttctttttagcagctaaaggatgggttttaggcagaactgctacaaaatcgtctgtttcagtaggtagccactcaatcgaacttggtggggcctggaagcttctggcaaagtggatcgtatcactatgttcatttgtatcgtcataagtcagttcgatactttctacttctttcaactggaccgtaaattcaggatgatgtttcaaaaattcggtaatcttggaaaagccttggtaattgatcatggttggtatcgttaagatatttaatgaaagattgttttcttgcgtataggtttcaagcacttcttgcatggcatggtattgttctacgacattttttacataagggagcaataagcttccagcttcggtcaactcgatttttctatgggcacgttcgaataatttgacgtctaattctgtttctaacgaaagaatctgtttagaaatgtttccttgggtggtgaattgtcgttcagcagttttggtaaaattcatcgtttcggctaaatcaagaaaaacttcaaatttatggatatccatcatattcctcctacttattccaataaagaatactttaacacaaaaaatgaattggtgtaacctattctgtctggtacaatctttcttgcagtgaaagcagtgattgcagaaaattttctgtaataattttcgctttatagagaaagagaggagtttttttgatgccaactggagttttgatcaatgtaggttccgttttgcttggcggactaattggcggattagtaggaaataaattaagcgaacactttaaagcgcagctgacgatggtttttggtgtgtgttcaatggggatgggtatctattccattgcgccaatgaaaaatatgccagctgttatttttgctttggtgataggaacagcgattggactgattgttaatttaggtaatgggattaacaagggcgctgcgttgatgcaagtgcctatttctaaaatctttcctagtgaaaagcttggtatgacccacgatgaatttatcagcacattagtgacggtcattgttttattttgtgcaagtggtacggggatttatggaagcttagattctgggataactggagatagtacgattttgatttctaaatctgtccttgattttttcacagcagcaatttttgcatgtaatttaggatatgtcgtttccgtagtagcgattccccaattcattattttttatatcttgttcttattggcaaaatttatttatccattgactacaccagatatgatcttagactttaaagcttgcggtggattcttgatggttgctaccggttttagaatgatcaacgtgaaaatgttcccagtagctgacatgataccagcgatgatcgttatcatgccactaagttggatgtggacgaattggatcatgccactgttataataataatcaaagagaagccattttttgctgactaaaagggatcaaaccttttagtcagtttttttgtatttgacaaactgattttgaaactatattatatgatgtataatatagattgtaataaaatattacacttgagaatagaaggtgacgtaatgcacatccagattccaactgttcttcttgatggcactgtgttagcagcattaagcaaagaagatatgtatggttatgccttaacaaaaatcgtacaagaaagtctctcagtcagtgaatctacactttatccggttttgagaagattgaaaaaagaagggtatcttgagacctatgatgaaccttttgaaggtaggaaccgtcgatattactcgttgacaccaataggaagtcgtcatttagaagaaattattgatgaatggattgtttttcgagattctttagaccggttattggaggagagcacaaatgaatgattatttgaatgaagttgtggatcatcttcaaaaaattcctgaagacgatcgttttgatttgatccaatattatgaggagtattttttagattccggaaaaacattagatcaggtcattgatgaatatggtacaccaaagcagtttgctttaaaattaaaaatcagttacttttcagaagaagaacaagcagaagacgagttagtgaggagtccaaaaagacaaatgcgtctgatttggttaatcattatcggtttatttgcttctcctgtcctcattccactagcattggggtttatattggttattgggggactattgattgctttgctggcgctcatttttagtatctatgttctatgtatcagtatcttaggtattggcttattcatgattatctcaggaatcagtgtgtttggtcaatcgattctgagtgggttattctttatcggtgttggtctgttcgccacgggaagcgcagtatttatttcgccactgttgctgaaaggaacaaaagggcttttttatgtcatgatgaactttgttaaatggatgggacggcgttttattacaaaaagagatctgcattcagcgggcgcttgaaggaggacagataaatgagattgaaacattttttgattaccggtattatcctgatggttactggcggactcctagcaggtgcaacttatacattaggcgctcaaaagagtctgacttgggatgatggccctcgattgatcgatatggtgacggagacgaaaaaaatcaaagaggcaaacaaaatcgtcatccatgcagaacatcaaacagtgtcagtcatacgcgggttggattttgagataaaaacgacctacgataagacagaaaagccagaaataaaggagaaaaatggtgtattgaccgtgaatgcagtcaaaaaatcagaaggtgcgattattagtttggaagacaccagtgcacaaatcactattgttgtccctgcagatcaggaattatctgaattgacaatcgaagggaataatagtgcaatcgacatcaacgaagtatcgatcaaaaaagtaaatactatgacacacgatggttgggtatcattcaatgaatttacgggaggaacaataacggcgaaagatgaattaggttctcttcgtttagatgaagtcaaggtggataacttgaccgtcataggagaaagcagcaatttacatctagaagacagtttggtcagcaaagaaggaaacgtcactctaaacaatagtaatttatctttgcatgagatggaaaacagtggctatactctccaaacatctggtgaatctcatattgaaaaagactaccagccaataacaaatacgttgttagagcaaggacagaaacggctgaagatcactgccaaagacacttcgatcaatatcacgacagatcaagaagacgatgaaacagattgatctagcaaacaactggatagtttaagaaaaaacagcaaagatcggaaggatctttgctgtttttcatcgcttaacacacataactatagtaaaataagtaagaacatatctataaagaaaacagggtgaaaaagtatatgaaggcagaagaaggtcaaagagaaaagttaaaaacagaaatggaaagattacatacttatatcactcaactaagtcaaaccttttatgatccagataaagaaaaagtgatggtcaactatccgaacaattcagaaggtcgtcaattagagcaagtgtaccatgaagttttcaaacatttattgacggtgaagaaagaactggactattattctttaccgattatcgatacaggaatattgaagtatgatggggagaaggaacgatttatctttaaatctgttcgggaagacttgcctctttcagcaggaatggatctagaaatcttggtagaagactattttacagaagaaaaacactgggttcgaacaagattggattatttgccgcaagcagccggaggaacacaagcaagcggttggtacatcactgaagacaaagatttggaactagaaggtgcaatggcgcgaattcgaaaaaaggattaaaaagcaacactatatttattgaaggataaaggagcgcagaaagtagaatgagagaaaaaagagcaatttatatcaatggttatgcaggaatcgtcggtttggtcgtattagctttagttggtttatttttcttctatttaggcatgtggcaagcgaaagtttgggcactatttttaagtatttttctttggctgatcgcgttactgttgctaagttcggcaactgtagtcagccctaatcaagcaaaagtgattttgttttttggacaatatttaggtacgatccgggaaaatggctttttccttacgattcctttggcacaaaaaatgactgtttcgttgaaagttcggaatttcaacagttctgttttaaaagtcaatgatttagacggaaatcccatcgaaatctcagcggtagtcgtgtttaaagtcattgatacagcaaaggcatcattcgatgtagcgtattatcaagattttgtagaaatccaaagtgagacagccatccggcatatcgctagccaatatccgtatgataccttcaatgatgatgatttgacgcttcgaggaaatactacggcagtgtctgacgagttgaaaaaggagttgcaagagcgtttagcagtagcaggtgtcgaagtaatcgaaacacgattgaatcatttagcctatgcaacagaaatcgccagtgccatgctgcaacgtcaacaagcaagagctattttgtctgctcgacaaaccattgttgaaggagctgtcacgatcactcaaatggctttggaacaaatcgaagaaggacaagaaatcaatttcaccgatgatcgaaaagtccaattaatcaataatttacttgtctcaatcattacagacaaaggaacgcaacccgttatcaatacaggcgatatgaaagaccgtaagtgatatagtttttgtaagataggaagaaggagtttaggacgattgtcttaaactcttttttagttgttcaatgaaaatgacaaaattgaaagaagaatgatagatgattcgaaggcataattgttcgtttttttctataatcaatatataaagtaagagagaaggggaaaaagtgaaaaaacttctgatcggactacttgttttcatcgttgtggcacttgcaggggtgaaaatcgcagattacgtagtgatgggcggagaagaatactatgtacagattacgacagatggtgcaaaaacagtatccaaagcagactctggacaagaaacagttaactatagatatatcctgcctggttatacgaaagagggtaaggaaaaagaactagatttcaatgggcaattgactcgaccgcttcgtaaaggagcatatttgaaaatcacctggaacaaaaagaaaggtgtcacttcatatgaagaagtcgaaaaaaaagatgtgccgaaaacagcactagaaaaactaattaaagggtagggaaagaaatgaacaaaatagtcgaagtacagaatgtaacaaaagtatacgggaaaaacaatgagaaaaagacgcaagcattaagcggcatcagcttcgatgtagaaaaaggtgaatttattggcatcatgggtgcttccggttcaggtaaatcaacgcttttgaatattttatccacattagacaaaccaacagatggacatatccgaatcaatcaaaaagatgtgacgacattaaaaggaaatcaactagcagattttcgtgcgaatgaaatcggctttattttccaagatttcaatttattagaaagtttgacagcacaagaaaatatcgctgttcctctttctttacaaggtgtcagaccaaaagaaatcaagcaacgtgtccaaaaaattgcagaacgtttatcgattgctcatattttggaaagctatccttctgagatttccggtggacaaaaacaacgggtcgctgccgcacgtgcattgatcacacaaccaacgattttattaggcgatgagcctacaggtgcgctggattctaaaagtgcccgtgatcttttagatacgatggacgaattgaatacaaaagatcatgtatcgattcttctagtgacacatgatccgttttctgcaagttattgccaacgtattttattcatcaaggatggcggtatccatcaagaagtgaaacgtggagatcaaagccgggattccttctatcgggaaatactatctattcttggaaacttggaacagtagggggagattgactatgctttggaaattatcacttactgggatcaagagccgtttaagagattacttggtattattctcaggattagttatggcatctgctattttttatatgtttgaatcaatggcgagcaacgaagcctttttgaaaagcaatacggtcgttgctgctacagttatcattttccgactaggttctgttttactagggatcatcacattcgtttatattttatacgcgaattcctttttgatgacgatgcgacaaaaagactatgccatgtttatgatgctaggagcaaaaggcagaaaaatcgcacagatgattttttctgaaacattcgtagtagggatcgcggctactttagtaggttcagctgtcggtgtaggattgacaagtatcgtccaccgattattagtggatcagttagatatcaatatttcgcattttacaccttttagcattcatgggttgttgatcaccgttttgttttttgctattttgtttttattagcagctattgtcaatgctttttcgattgtcaaaaaaccgattttagcattgattcgtgcggatcagacaccaacaagaatcaagcagcataaattcttgttcttccttgaagtagtactagggattgcttttctaggctgcggttattatatgatgaaacatgtggggacctatcaagtttttggtatgggagtagctctagtcacgatcgtattaggaacttatttcattttccactctgtgatcattttcttcttatcattactaaagaaatcagaacagatttcattgaaaaaattgaacaatttcacattgtcacagttaagttttcgtattcgtgaatatacacaaatgctctccatggttgctatgctgtttgctttagcacttggtgctttgacagtaggtctaggatttagaaatgaaatttcggaaatgacggaaaatgctgctggttatgacctagtgatgaataatcctcgggcagaagatcagcaaaaaatcaaagaactatcaccaacactttctgctccttatactcaaaaagaagatgcgggaacgatttactataatgcaagtgaatttgcggctcaaccattgatcatgataaaacatgaagatgggacaccgccgaaaatcacgaaagaaaaagttcctgctgaaaaaatgaatgaactgactgtacaagatgagcttcgtggctatgaattgcctgaacagcaagaaaaagaaatcaaggtagtcagtcaatcggaatttgatcaactgagtttgccacaatccactttacagctagttcaggtcaaagacttccaagcaaacttggaaccaatcaaagcacttgctacacaaaataaaacgaacaatccatctttgcaaaaagtagagtacagtaaccagaagtatgaaatgtatgaaggatataatagtctattctctggttttgaatttatgggattcttcttaggtttagctttcttgactatgcttgctagctgtttgatgttcaagatcttgtcaggaagcaagagtgacatcgctcgttatgaaatgcttgaaaagataggaacacgacgcggattgcttaaacaatcgatccgtagagaagtaggtgtgttattcttagcaccaggaatcttaggtgtagtccatgtcttattcggattacaaatgtttggtctattcatgcaaaatccatataaagatatttgggtgccatttacgatcttcttcgtattgtatttcatctactatgtactgacgacatggttgtatactggaatcgtattgaaaaagaggttgtgacagaagtgatcagcttcaagaaatttcggcttatctccgaagaagctacttctggaacaccgtttgttcagaaagagggactgtgacaagatttttgtcacagtccctctttcgtgatcttttattagaatatagtaaattttttctcgttactcacggaataagctgttaagaaaacggtttccatgtatactggaatcagtacaaatgaaagaaaagagggtgcaaggaacatggaaatcaatgaacaaaattttggcggaaactatcacttgatcacgatcacgaatcaaaatgggacatctttgtctgtcagtgatctaggtgcacgagtcgtccattttcaaacaatgatcgataatgaaaaacgagagttggttctaggctttgatgaagcaaaagaatatctggaaaaagatccttatatcggagcttcaatcggacgtatggctggacggatcacggatggcacattcaaattagatgatgaaacattcaaagtaaaaacagatccagatactggccattgtttacatggcggtgcacctagctttgaagccaagcagtggcattatacagttattaatggtgagaacgaagcctcagtcattttctatcagactagtccagacatggaaaatggatttcctggcactttagacgtagaagtacggtatacactgacgaatgatgatacatggcgagtgacagtccaagggatcagtgaccagaaaacagtattcaatccgacgaatcatgtttatttcaatttaactggtgatccaacacagccaatcgacgaacatacgctttggttgaacagccgattattcgctacgctcaataaagatacgacgcctacaggagaagtggtttcagtaagcggtacagcatttgactttcaacatcctaaaaaattaggtgaggtattcgccagtgattttcgccaatcaacgatggtaggcggtatcgatcatccatttttattaaaaaaacaggctgatctgctaaatgcagcggaattgacgagccctgatgaaaaagtatcaatccaagtaaaaacggatgcttcgggaatcgtgatttttaccgcaaattttggagaagatgggccagaaatgcgtggaaaaaaattagtagatcatggcggtatcacatttgagactcaagaactaccaggagcagagcgacttgaaagttttggagatgtcactctggaacctaaccaagtacgcgaatttgtaacggaatacaaaataaataaatataaagaaatagaataaattaaaaaaggggatgtgacactgtcacacgcccttttttatttattctatttctttaaaggcagatcaagccagaatgatttgtctaaacttaacaaagttagtacaggaacagttgcagctttaactgtacgagtagttgtttctggtatctgtcttgccgtgaacgtgttccacaaatcccagattgaagcgacacggaagatggaagaagcattgttgacgcgttttatcgttgaaaattctaatcctgtgattggcacgccatctgttgtccatttgattggcacatcgaatcgcttagacatatggagaatttcagtatttgcttcttcagttgttgttgcttcttttttcggttcatcatattttgtcaggtcgtacgcttcgatgatcgcgttcaatttttgtgaatattggcgatctgtagcataacgtccttccaaatatttggttgcttctttgtagtcttttgtttccgacttccaagttggtttgtagaagtcaggattgccagtcagtccatttttgatcaagtcggcatagtcttccaaactttccttgtaagaaggatacttacggaattgggcgcggatttggtagctttgtcccgaactatcttgttcaagtgtattgaaggtcacgctgcttcctttatacgatcctttgataccaaaaaggttatgatttggttcgcttgataataagctgtttccagatccactttccaggatggcttgagccatcatgactgatgcgtagattccttctttttggccgatttcctgtgcatcatctgcaatctttttcaggaactgatcagttgtttggttttgactgaaatggaacgagccatctaatccatctaaaatagatgagccgcctgtcagcgaacctgaagcagcaggtaaacctgctaagtttactcggacagcaaaatcaggcgtgaaatctgaaatagaagttactcgaactttatctcctggttggggcgcatggataaattgtccgttcccaatatagatacctacatggtgagtaacaccggaagaaggtccccagaagacgagatcgccaggttgggcctgacttactggaatctgcgtacctgcatattgctgttcgcctgtccagccaccgatataatgaccggttgctttcatatatacgtaataagtcaaaccagaacagtcaaaagtatttggaccttttgctccccatacgtatggttttccaagatgcttgaatgcttctcgaacgattgcttgttggacatttgttgcatttgtaggcaatacagcatcaattggtgattttacaacaaaatcagaagaagcagaagatggatcctctataccgctttgatttgctgtatttggacgagacgaagcattgttcgttccgccattcgatgaaccattgtttggatgatttggttctctctgagtatttccattgttattcgatccagatgggtttgtttgattcgaagaattcccgctgttcgaattattgttattattatttgaattatttgaattatttgaaccattattattgttgctattgttgctattgttgttattaccctcatctggtttatttggcgtttccggatctggtgtactagggacttcttcactaggatcagttggttcctctgttgaagtatccggtacaggttcaaattctgcagtaatagataaattgttcgtacctactgtaaaagtctttgcctcatagttcacttctttagcaccattcacagcgacggaagcaatttgttcaccttcagctggcgtaatagtgtaagtcacctttgttcctgctgataaaccttctaccgttccgctttctgtgatattcaaaggttgctgttcagcggtatcctctgacgaagcagttagttggatcttccctatcaaagaaggagcaatcgtaagggtatatgtctcggctggtttttcattttctgatggatcagccggatcagttggttcggacgattctgttgatgagtcagttgttccggttgtgccttctgtagaagaatccgtagtttcgctagtagatgagctggaagtagacgtacctgttgagactgtttgatcggttgtttgattatctacagcaaatacggcattagtcgacaaaacagtaggagcaatcagccaagtagcagctagcaaacgcatcgtttttttgtttttcataataaactagtccttttcctttcattgattttctgttttattcagcattcataagttattcgattgaacagataatcgtgtcgaaaagctttttctttccatgaatctgcttgtgtattctaaataaaacaagttgtaaaaaagcaacgagcagtcattcgttgtggtttgtcgttcattttattgcataaaccatctttgtttggggataaacaagtggggataaaaatggtcatgcatatgtaaattataccaaagattggagagtatcacaaaaaatttataaaaataacgatcctaaaaaagaaaaaaactgaaatatgtgataagcatctcatacttcagtcttttttcgttcattattcgtaagacattaggtcttcatcaaacccgctaacaagggtggtgatcattgctacgactagactaacagccaatcctgctaagtaccagaaaaaagtaccggaaataaaggctggcaatgtggtcagactaccaaatacaaaagcgatcgctttcacttgagcaaatcccatgacagctccaccagcagctgcaccgatgcaagcagcaacaaatggttttttcaatggaatcgcgattccgtaaacagtaggctcggtcactcccgcaagtaaaatcgaagcgaaagcagaaccagaaatcgaacgtgtttttgaacgtttacttcggaggaatacccctaaagctgcaccagccattccaaaattagctgctcctgtcaacggaacgatacggtcgaacccataagctgagatattgctgatcatgacaggatttacagcccattggataccaaatatcaccaaaatgttccagcctccagcgatgattgctccactgatcggtccgttaatatccatcatccaagtaattgctgcagctaaaccttcaccaagataaacaccggcaggtccgaagaccattaatgtcaaaggaaccgtgatgactaatgaaagtaaaggtacaaatactaattgcatgttttcacgaatatattttttaaggaatctttcgacaaaagaataaaagaaaatacctaaaatcgccggcatgacagtagacgtgtactgcatcagcactacaggaatccccagaaaatcagtagctgctttaccactatctgaaagtaaagaggtcaaatttggctcaatcagcgctgcagcaatgacagccgcgatatatccattcactttaaacgttttggcggcagaaaaagcgagaaagattggcagaaaataaaaggcagcattcgacgcagcagacaaaatatgataagtcccgctcgtttcactaagccagccaatcgtagtcgctaaaacaaccagaccttttaatataccagaaccggcaaataggggaatgattggcgtaaagatttccgatatcaaaccaaatagtttttcgatcggatttagcttttctttcggagctgaatgatcgatttgacgtgtcaattccttataagcaggggccaatccctgatccataattacttctgcatatctatcgagtaaaatgaaatatttgatggaagggatttgctgctttaatttttctacatttgctgccggctgtttttgtaatttgatacgaagccgagtcgcacatgggaggacagaatcaatattgtcttttccccctaactgatcaatcagcagatgaatctgttcggacagtaccatctgttcaggattcattgtcgtttccattagaagaccactccactcactaagataatattggcataaggtgtcatctcgcctgtacgaataaatgcatggcagttattcaaatcttttttcatttcttcatgtgggataaagctaatcggtgtatctggtaacagtaatttgattttttccaatatttccggattcattgtctttatttcttccgccaattcaatggattgtacttcaagttcttctaaaacgttttctaaaacagacaaaaaacttggaagtccgtttgaaacagctaaatctattttttcagtaccaaagggaacaggcatgcctgcgtccccgatacttaatttgtcaaagtgtcccatttgtgcgattactcgcgaaatatctgaattgatgacttttccttttttcatgtttgtttcttcctctcgttgttaatttatgactgctgattgttctaaagcttcacggtaagggatagaaggttgcgcaccataagactgtacggcaatagaagaggctagatttccataaaggatcgcttctttcaagttaccaaggtctggcagaagtgtgctgctcaatgccccaataaatgtatcacctgcggctgtcgtatcgacagcatctactttaaaagcagggacgataccgtgttctttttctgtgtggtagaaagcaccggcactgcccaatgtaatgattactgttccaatgcctaattcatgcattttttcagctgctgcgaccaaactgtcatggtctgtaactctgattcctgtaataatttctgtttctgtctcatttggtataatgatatctgtcttttcgagtagttcagtaggaatggtttctctagctggtgcaggattcaggatcgttgtttttcctgcgttttttgcaatagaaaaagctaggatcgtcgcatctaaactactttcgaattgagcaataataaagtcactgtttgtaatcaattctttgttctttcgaacttcttgttcatggaaagcattatttgcgcctgcatgaatcaagatactgttttctcctgcggcatccaccataatcattgcttgtccggttgcggcgccctcaatttcagcaattccagatgtatcgatgttttctttcgtcagtagatccaacaattgctgtccttcactgtcagttccaacacctccaataaaagatgttcgtgcgcctgaacgtttggctgccactgcttggttggcgcctttgcctccgccagcgtgaaaaatctcatgtgcatgcatcgtttctcctggttttggcattttggttaaacgaagggtagtgtccatattaatacttccaattactgtaaccgtgttcatttcacaaacctccaactatctcatttattttgatgggaagaattatttttttaaaacgttttagtaaaacgttttaatagttcgataaaaatatagcacaccttgaaagctatttcaagggtgcagtcgaaaatcttttttctagtcgtacaggtagccgtttttcttcccactctttttctgggaattggattcgatctaacaataattgggcagatgtttgccccaattcgaagattggttgtgcgattgtcgtcagttttggcttgatatattcgcacatatctatattatcatagccaataatgctatagtcttctgggatgctttttccagcttcctctaatccgcgatataatccaaaagctaattcatcatttaaagcaaacacaccagttgcagcagaatcaagaagtttggctgtgatttggtagccgccttgttttgagaactgtgtaggcaagaggatcagtcggtcatgagggatttggtaaacatcaagagcagatttaaacccatcaatccgagcgtggacattttctggcagattttcaggatagacaagggcgatcgtttgatgtcctagactaagtaggtgcatacctgccagataaccaccgcgaaaatcgtctgttcgtacggcatcactaaatccttcagattttttttgatccaaaacaatgaagggccggccttgttttttcaaattttcgttgattgcattcgtagagacagcagaagtcgcaataatgaatccatccacacctcgacgtgtgagctcggctaggtactcgatttctttttgatgatcagaatcagcattacataatatcgtgacgaagttctgattgtacaagatatcttcaattcctcgcatcaatgtactgaagaatggattcgtgatatcaggaacgagtacgccaatcgttttcgtttccttggtaatcatttgtctagcaaaataatcaggttgatagcctaattcttctttagcagctaaaactttctgaacggttttcggactgaatttctccgtatttccatttaatatcaaggagacagttgtgattgaaacaccggaaagtttagcgacttctttgattgtgatcttttttttcaccatgttcatactcctatctaaatcctgtggttattttcccatgaaatcaaaaagaagtaaatgaaaatcacatacgctagtaccctatttgctttgttggattgcttcgattatttgtttcgttgaacgtactcgtgcagttttcggaaatatcttttttatgaacaattgatgcgattctttgtcgcgatcactacaagcatcttcagcaagcacgacatggtacccgtgttgaaaggcatctaatgcagtagcatatacaccgtttgttgtcgctacaccgcttaaaatgatggtttcgattccacgacggcgaagttgaagatcaagagaagtaccaaaaaaagcacttggattgtattttgtgatagtcaacatattgtctgtatctttcaaagaatccttcaaaagtaaatcagtgaattctggaggtacagaagcagcagtcattccacccatatcagtttgttgactcaaataagggaaagtggagatgtctacattcactaaaactttcaaggcagcggtacgtttcaatgtttttgctaacgaatcattgtttgtcagaatagatgctgcagtgtgtggagagagtgtaccgttatttacgatccctttttgcatgtcgatcgcgacaaaagcagtttttgataaatcaaaaatcatatttttctttaaatcattcatgatgttccttctttcaaataacaatgttttttatgtaagtaaatcataaatcgtttatttgtcaactaaataaagaattcctttctttagtctagagaaattcaatggtaaaatgaataagtgtgagaaaacgcattcgatgcatagatatagcgagaaatatcgtgaaaatggaggaatcagagtgaagtatgtcgaagtaaaaaatgaatacaaacgatacaagatgggagaaacgaccattacagcaaatgacgatatttctttttcaattgaaaaaggcgaattagtgattatacttggccctagtggagcgggaaagtcaacgattcttaatattttaggtgggatggacacacctgatgaagggcagattattattgataacacagatattgcacaattttcagacaagcagcttactgcttaccgacgaacagatgtagggttcgtcttccaattctacaatctcgttcctaatctaacagcaaaagaaaatgtggaattggcaacggaagtttcccctgatgcgcttgatcctgtcgaagtattgacgcaagtgggcctagctcatcgattgaataactttccgtcccaattatcaggaggcgaacagcagagggtttccattgctcgagcattagccaaaaaccctaaactgcttttatgtgatgagccgacaggtgcactggattttgaaacaggaaagcaagtattgaaattattgcaaaatgctagcagacaacacggtaatactgttttgatcattacacataattctgctttagcgcccatcgctgacagagttatccacatcaatgatgcgaaagtaaggacagttgaattgaatgagcatccttcatccattgatgagattgtatggtaggaggattttatgaaaacaaaaacatatcttaaagcaggttttcgcgaaatccggcaatctaaagggcggttcattgcaatcatccttattgtcatgctaggaacacttttattcgtaggtgtcaaaactgctggacctgtcatgcaaaaaacgatggatcactatgttgatacagcaggactttctgatttgcaaatcgtttctactggtggtttgacacaaaaagatatcgctcaagcagaaaagattccagatgcaaaagtagaaacaggaaaacagttctattattccaatactggcaaaaatgaagtgattcaaatcttttcttataacaaaaatagcaggcagaacaagctacaattaattgatggaaaatgcccggaaaaatccaaccaacttttattagatgaaaaagcggagaatgaggagaatgaagggtataaaatcggtgatgtctatcagattgattcagatgaattgaaagaaaaagagtataccatcactggctttgtccgttctccattgttcatcaacaatttggagagaggatacgcgaatgtcggaaatggtagcgtggattattttgtctatttgcctgaatccaatttcaagacggatatttattctgtcttatatctggattttacgaacgtaaagaatttgaatacgtacagcaaagcttacaaagataaaatggagcaaaatcaagaaaaggcagaaaagtatttacaagatcgacccgaagaacgcttagaagagctgaaaaaatcggcaaacgaagaattagaaccagcacagcaaaaaataacagaaggcaaagcacaaatagcacagggaagaacacagttagaagatgctaaaaaacagttagcgcagcagtcagcagctatccagcagcttcctgaagcgcaacggacaatcgctgtacaaactttgtctcaacaagaaactcaactcgctgaacaagaaaggcagttagttgagaaagaacgagaactagcttctgcagaggaagaatggaacaaaaatgcagaaaaaattgaaaatttaactaaaccatcatacctatacaatgaacgttcagaaaatgtcgggtttcaagaatttggtgatctggctgaacgtatcgcagcaatcgccaatgtttttcctgttttctttttctttattgctgcattgatcacctttacgacaatgacgcgtatggtagaagaaaaccgcagggaaatcggaacattgaaggcgttaggttatacgaaagttgaaatcgcaaaaaaatatgcaatctatgcaagtctagcctcaggaataggcattgttttaggaacgatattaggaacgaatcttttaccaaggatcatttttgaactatctaacgagcgatatgacattgggagtgcccttgttttttatgactggccacctattttacaagcagctgccgcattcttcattgccgcatttggcgctgcaatgattgttttgttcaaagatttaagagaacggcctgctgcactgcttcagccgaaagcaccgaagccagggaaacgtatttttcttgaatacatcactccgctgtggtcacgccttagctttaatcaaaaaatcagttatcgaaatctcttccgatacaagtcaagaatgcttatggcgattatcggaattgctggatgtgccggtctgatggttgcgggcgtgggattgaaagattctctaagttctgtctcagccaaacaatttggaccgatcattgactatcaagcaattgttacattagattcatccacggaagagaatcatcaaaaagcagcggatatgttgcagcagcaagaaaaagtaaatgagatcctagctattcatactcaaaccgtagaattgagaaaaaaagggcatgcttcacaaagtctgacagtgatcgtaccgagtaaaacagctgattttgatcgttttatccatttaacagatcttgaagagaacccacgttccttacctaaagcaggaatcgctattacgcaaaaagcagcagaactatttgacttatctacaggagatcatatatcgctttatgatgaaaatcaaaaagaatggaaagtcgaagtaaaagaaatcgtgaaaaactatctaggcagctttatttatctgtcccctgaatattatgcttcagtgactgatcaatcgatgtcggataatgcatttttgctgcgtacagataagatgacaacgaaagaagaagaaatgctttccgagaaactgctggctacagacgctgtgacaaatacgtctttcatgtccaaacaaatcgaaacgcaagaagaatcaatggcgaacttagactcagttgtattaatctttgtcgtattgtcaggattgctggcttttatcgtcttgtataatctaactaatatcaatatttctgaacgtgtacgcgaattatctacgataaaagtccttggattttttgataaagaagtcacgatgtatattgttcgagaaaatatcatctttactctcttagggatcattggaggatttggtgtaggatatgtattgactgactttatcttacaacaagcatctatggagaatgtcatctttccattagtgattacatggtgggcttatgttttatcagcaggattaaccatcgtattcacggttattgtgatgattgttacccatttcaaattaaagcataccgatatgattgatgcgttgaaatcgaatgaataaaaatagaggttgtgaaatcagcggtttgacctgagtattagagaaacaaacggcaaaatagttcctcatattttgccgttttttgagctaataccgaaggccagctgattgaacaccgtttaagaaagaggttgtgacagaagtggtcagcttcaagaaataagaaggaatttacgaaaacagctcctcatatttttcatttgaaaggacttattgtcgtagatgtaagcttctgaacaacatttatagaagaaacaagaactttaaacaagagactagacaaatacatgtctgttctcttgttttttattggacaacaccctcttaggaagtataaagataaattttacaaacgctttcggttcagttataataataaatgataacttgtatatataagttgtgataagtaagaaatcagttgaatggaggcaaatatccatgacatttaaagacaaagtcatttatcaaatctatcccaaatcttacaaagacagtaatggtgatggaattggagatttaaaaggaattaaagaaaaactgccatatttgaatgatctagggatcgatatgatctggctaaatcctatttatccaagtcctcaaaaagacaacggttatgatatctctgattacacagccatcgatcctatctttggtacgatggaagaattcgagcaactaatagctaaagcaaaagaataccaaatagaagtcatgcttgatatggtattgaatcatgtttcgacagaacatgagtggttcaaaaaagcactagcaggggatcagtattatcaggacttcttcattttaagagaagaaccaacggactgggtatcaaaatttggtgggagtgcttggtcgccctttggagatacagggaaatattatctgcacttatatgatcagacacaagctgacttgaactggcggaaccaagcagtaagagaggaattattcaaagtagttcgtttttggatggaaaaaggggtaaaaggattccgtttcgatgttatcaatgttatcggtaaagacgagcaattgaaaaataataaagaaaatgatggtaaacctgaatatacagacaaaccaatcacccatacgtatctaaaagaattgaaccaagcaacgtttgggacggattccactatcatcacagtcggtgaaatgagctctacgacgatcgaaaattgtatcttgtatacagaacctagtagagaagaattatcaatggtctttaattttcatcacttgaaagtcgactatgaaaatggcaataaatggtcaactcctccatttgattttgcagaattaaagcgactgttccatacttggggagaaaagatgagtgatggtaatggctggaatgctttattttttaataaccatgatcagccacgtgcgctcaatcggtttgtagctatcgatcagtatcgaaaacaaggagcagagatgctagcaaccatgatccatttaaatcgtggaacaccatacatttatatgggagaggaaatcggcatggtcgatccagactattcctcgatttccgactatattgacgtagaaagtttgaatgcttacaagttgctccttgcacaaggatgtacagaaaaagaggcgttccgtcgaatcaaagcaaaatctcgtgataactctcgaacacccatgcaatggtccgatgcagaacaagcaggttttactacaggaaaaccttggttaaaagttgcaggtaagttagaagagatcaatgtagagaaagaacgatcttctgaggattctattttgtcctattataagaaattgattcggttgagaaaaacatatccaatcgttgcacaaggcgattatcatgcttatggagcagatcatccgcaagtttatggctatcttcgccaatttgaagggcagcagctacttgtattaacaaatttctatgataaagatacaaggatcaccattccagaaggattcacagaagccgatattcttatcgataattattccgatactgttctccatcaaaacctggagctaaaaccatatcaggcaattgctttactgaaaaactaaaataaaaaagtataaaacgccgatcctacgagctattctcgtgagatcgacgttttgtgttttatttaaaataatcttcttcagaaaatgaagagtgttcatactctcctttgtcgccataaaatttattgtagcgttgtttgaatttacggaaaataaaagtaacgagtaatttgactagcgtatagataggaataccgaaaataacgcccacaattcccattagatcacccatgacaagcaaaacgatcaagatcgtaatcggatggatctgcaaacgatcacccattactcgaggaattaccaagtcaccatggagaagttgtacggcaaaccagacaatgacaaatttgacagccataaaagtagagtcttggaatgcaatgatcaaacccgggaaaaaagcgataaacggtccaatatatggaataatacataataacccagcagaaatagctaaaacactggcaaattctaatccgatcagtaagaaacaaacccagtagactgctccaaggataaatgaagcaatgatctgcccctttaaaaatgaacccaattgttgattagcaatctttgtcaaatttttaaagtctgtacgaaaggctggtgggacaatggctaaaactgactgataaaatttttgaggatttctcaaaaggaaaaaagtgacaatgggcccagtaaataaagtaatgaaaatagctgtaacagttgaaaaaatattgctgatccgttgtgcgccgctttcccaataatttccaataaagccagctatatcagacgtcacgtcatcaatagaagtaaaaaattgattaaatgaatcggcaaaaggtgttttctccaaaaattgacggagactctcttggaaatcttgaaataaatctggcaaactgctaatcaatgtttttgtctgttcttcaagaaaaggaacaagccatacgcttccaagccccaataaaaataaaataatcacataaacaataatgactgacaggttcctcgaaaggtgcttgcttaaacgcttgatgactggttccaaaagataatataagatcagcgcaaacaataatgggggcaagatagtagcgataataatcccaacaggcttgaatataaatgaaatctgatggaaaaaataaatgatcagtgccagcaggatcaccatacctaaaacatagtaagaggttttgcctcccaaaaagcggatcaaacgattcgttgtatctgtttcttttttcactcattttcctcctttgtctataactttattatagacaaaagaggggataaaaggaaaatgatagaggttgattgaaaaaatatcgtgaatcatccatacaaaagttctcctcaattaaaataagaaaacgcttgacagctcttttaaccctatgataaattaaattctgttgctaaaacgtaactattacgatttactagaggcgaatcggaacattatgaaagaagatgagaaggagtgttataaatgaaacgactgataggtatattggctacactggttttaacaggtatgttagctggttgcggggcaagtggagaagcaggggacagtaaagaaaaattgagcgtgatgacgaccttttatcctatgtatgattttacaaaagcaatcgtcggggatgaaggagaagtagaattattgattccagcagggactgattcccacgattatgaaccttctgctaaagacatggcaaagatccaagatacagatatctttgtttataatgatgaaaacatggaaacatgggtccccgcaatccaaaaaacattacaagaaggcaacgtccatacgataaaggcgacagaaggtatgcttttacttccgggaagtgaagaaggacatgatcatgaccatgaacacggggaagaaggtcatacacatgagttagacccgcatgtatggttagcaccaagtttagcaatcaagcaggtagcaagcatacgtgatcagctgattgaagcctacccagaaaaacaggaagtatggacaaaaaatgcagcagcctataccgagaaacttcaagcactccatcagctttatcaagaaacatttaagcaagcaaaacaaagatcttttgtcacgcaacatgctgcattcaactatctggcattagaatatggattgaatcaagtatctattgctggtctttattctagtgaagaaccctctgcggcgagaatcgctgaactgaaacactttgttaaagaacatgggatcaactatatttattttgaagaaaacgccaaagatagtattgctagaacgttagcaaacgaagcaggtgtatctttagaagtattgaatcctttggaggggttgacgaatgaacaaatagaaaatggagaaaactatctttctatcatggaagcaaacctcgaagcgttgaaaaaaacgacagagacagaaaacccgttagaagatactttgacccccaaaaaagaaaagagcgtctataacggttatttcgaagacgaggatgtacaagatcgctctctttcagattggtcaggaacttggcagacagtagatacgtatgtagaagatgggacatttgatcctgtttttgaatataaagaaaaattgaatcaggataaaacagcacaagaatataaagaatactatacgaagggctatcaaacagatattgcttcaatcaagatcggtgagaaagagatggcatttacgtttaaggatggaacaacgaaacgttcaaattatcgttatgtagggaaagaaatcttgacctacgaggcaggaaaccgtggtgtaaggtatctattcgaagcagaagataaggaaagtggcgcgtttagatatattcaattcagtgatcacacgattgcaccggctgactccgaacattttcatttatatgcaggaaatgaaagtcaagaagcattgctaaaagaaatggaaaattggccaacattttatccagacacaatggatggccgtgaaattgcacaggaaatgcttttgcactgagagacaaaaagaaccgaagggtttggatcggctgattatttagtcggtccaaactattcggttctttttatgaaattaacttttttaatccacggatagagacagggatagtctcaccgtttgccaacgtgacttctctggtttttttattaatcgaccgcacgttttgtgtgttgataacataagatttatggcaacgaataaaattccgatgcattttctcgatttctttgatcttctcgtagaattgcaattgagcatgagtcaaatgaacttccaatttatgtggtgcgcctaacgaagtagaaaaatattggatttctttgatcggtaaaaatttgatctcatcattgaactctattttgaagatatctttttggatctgggacatttgaaaatcttcaaaaattttgctcaggatctgctcgacattttcttttaaatcataaaggtcttctttcacaatatagtcagtcggctcaatgttgctttttaagattttcatcgacatttccgtatgagaagtcacgtagatgatttttcctaaaggatctaattcacggatcaatttaccaatcgctacgccatccatttcactgtcttctaattcaatatctaaaaagtaaataccaaaagaagaagttctgatcttggccgcattgagaagttcttccggatcagaggtagaaatatgaacataactgtctaagttttcaatcatgatcctgtttttgatcaccgttgataaaacttccaattgttttggatcgtcttcacaaatataaatgggaatcatatcattactcctttattttatttgtatataaatcgtttgagaaaaacgttggttttcaattgatgtttcaaggaaaagataagggtttgtctttgtcaattcatccaagataaacaagccaagtccttcgttttttggatttgtttttgttgagaaacctttttgtttcaactggtttaacggtaatgtattggttgttgtattgattacacgaatcatcacggaatgatttttcttgatgattgtcaattcgatctttttcttctttgcagcactagctccttcaatcgcattgtccaagataataccaagcatacgtacaaggtttaccgtatgtttcgtatccaactcgattggcttaggaaaatgaagctggacgatcaatcctttttcctgtgccatcataagttttaatgacagcaaactgcgtatttcaggaactttcatattatccaacatacttagattggccgggaaaaggttcatcatctggcgtgtaggcaatatcgtttgatcgtagtacgaccgtaatccttccaagtcgccttctgcaatatagctgtgaagagaaaagagcagattttggtaatcatgtttgaattctctcaagtcttgatagtttttttccagatctttgatataatcctgctgcatcctgacttgttgctctaacaactgatcagctaacttcttattagagattttccaataataaaccaagatgatcaagccgacacacagatagagaataaaaaaactagtattcaaagctaagacatcaggtgtttcaccagaaaaacgggtataaaaaataatgatatagtatgtaaataatatcaacgtcccaatcgtaccgatcatacggcggtccactgtgtgaaaccaagtctctaacgattttttaaaacaaaaagctaataaagcagataaaagagcggataaggcaatgtgaaaatactgcaaggaatctcctggttcaacaaccgcagatttcaaaacaaaaaaatcgccgatgcttgttaaatgatctcctaaaagcgacgtcaataatccaaaaggaagcgcgtaaactaattgttgacgcgaagtcgaaaagaagaaaaaagtaagcatcagcattcctatagcaattagagcagtaaaaatccctaaaactgagtagacccatccaatcaaaatgcaagaaatcagagtgaatcctgcaaacagataattgtatcggatatgatggtcaatcaataagatacaaattgtgtaaatcaaatattgcaacgctatggaccataaaaacataaagtacagctcccattgatttttaccaaattatagcacaattagcgtattatttttttaatttttcagggattttgaattcagaactcataccaaagcagcagccagatacaaaaaagtcagataagttagttaattgtttaatgattgtttttttcatgaaagattcctccaaaattcatcaagtagtttgtaatagggagcaacgtagctatttctaaaacaatcccaagtagcaaataggtagaaaagtaagaagctgagaaaaataaagtgatgagagaaaaaattagaaacatgctgatcgccttctttaataatggtggacgtttctcgggttcaatgggattgatggctgtacctcttgatccatagcgaagcagtaacaaaaagcagctgattaacaaaaagaccatcattgggaaggagatagtcaattgcagatgtttcatcaccaaaggaacgccccataaataaagcagtgtccacagcagacaaacgaattcagagtcggaatgcaatccataagcatatctgcggatgcagatataggaaagaaaggtgattcctgtttccgcccatgagcccgtcaccagagaaaacactagaacgaccgctagttttccaaggttgttcaataaaacttctaaggcaaattttacttggacatacaccatatcttcttccgatttgtctccgctgaataaggtttctaataatttgttcacaactttatctttcatctcatacgtacctccaccacaaattctatgctaaaaaaaataaaaaacgtgttttgtttcataaaaagtggttttgacatcaaaaccgtcatgatttccttaaaaaaatcttcatttttttaaatcctttccaaaaaaggtgacagttttgatacgaaaagtacattttatgacaagtttgtgttttttcgagtattttatgttaaaaatttactgaccttagaaaaggtgatggagggattcttatggaaaatgaacaattgtttgaagtcggcgaaacatatgcatttaaatctgatttatttgaatcaccaataaaaggaaaaatagaaaaaatctatgaaaatagcgtgatgatacgtgtcatgaattgcgcagcagaagacaatgataccgctcataatctgcactggcagttagtcgtacgcaaatcaagtacaatagaagaataaaaacagataaaatgttgagagcataaaagagtagaagttcatccattctactcttttattttcatgaataggcgtgacttctagctactattggcgaagcagcctttaaggagcagataaagtcaaggcttttatttctataaatgaagtagtaaaatgaagaacagattttattacaggaaggatgccgataattgtgattattgttgcaggaacgatcggtgcagggaaaagcacactgactgaaatgcttgcccaagatttagaaacaaaacctttttatgagaacgtggaggataatgaagtattgccactgttttattctaatccggaaaagtatacttttttattgcagatattttttttgaacaaacgttttttggcgattaaagatgctttcagccatgatgacaatgtactagaccgctccatctacgaagatagtatgttgtttcatctgaatgccgatttagggcgtgtttctgaagtagaagtaaagcagtatgagggtcttttagagacgatgctgaaggaattagaagaaatttcgccgcaaaagaaaccggatctactggtttatattcgtgtatcctttgaaactatgttagcaagaatcaaaaaaagaggtcgggaatatgaacagctagagcaagatcctgaactctattcctactataaagaactcaatcgacgttatgaagaatggtatgaacagtttgatatatgtcccaaaatagtaatcgatggggacaaatacgatttcgtagccgatccagcatgtggagaacaaatcgtacaagaaatcaagatgcgggcaaagaaaatgacagaagaggcagatggccagtcgatccgctacactacaaataacccgaaagcaaagggtatctttacaactaaataataaaaaaactaagcaaattgctcactcacaaaatttctttgtgaacagcatcctgcttagtttttttgattcaggggaatcaaaaggtgaaacggttcgtatgataaaactgccataactgaaatgtctgagtgagggccatgatcaagaataaaatagaaacgaccaaaatcgaataggcgccaaacaaatgatgacagaatacaaggacaatagcccctgcgataaaggcaagaacgacagttaaatagtggaaaaatcgatcaaaatctgctttttctttagaaatacaataatcatataaatttgttgctaccccttttaaatttcctgttgtgaataaattggtgtaggcacgcccgttgattttatcaaaagccacccactggatcgaggccgtaaaagcaattaaaatcgttactaatgcgggatgttcatggacaggtgtcaaactgacaaagaaaaaaatcaccgcttcataatatagaacaaataagcgccagaaatgtttttctttttttctaaaataatcaatcaaatactttgttagaagaatccctaagaaaaagaaaagggtagacaatacttttttgccaacgcttagccactctccgtcaaaagcttggatgatcgataggatgatattgccagtttgagcagaggcaaaagcaccatactggatataagtataactgtccattgctcctccgataaatgtcagcaaaagacctattgtacgcccttcgtgaaaggaagtctgcatttttttcatcaccttttatgaatataattttgtcttccttatcttagcataaacgattgaaaaaaaggaaaaattttcagaaaactaaaatcatctcgctccccattttcatttttagaaaggtctgttagtataaagaaaaaatagacaacgagattttaaataatcaaattggaagaaacaacttcaaagaagaaagatgggaaggaaatcaatcagttggatgaaaaagaaattctccgattacaaaaagaactgaatcgttgggagaacaaatataaaaagcttcaacaagtctttcggctacaagaagaaatcattgctacctatgaagcggcttatggagaagcccctggacttattgaggaagaaatgcaggaaaaagatagcaaagaaaacaactctttctttaaaatgatggagaaacgttcttataatcgcttcaatcaagaacaaaaagcagctatcacatacgatatgcagaaacatcttcgaatcatagcgggagctgggagcggcaagacgcaaacaatctgtgcaaaagctgtgtacctgatgacacaaaaacaagtagacgaagaacgcatactgatgattacttttacacggaatgctgcaaatgaactaaaaaaacgagtagataatttcagccaaaggaaaactgctgtccatatcggaacattccacagtatctttttcaggatatacaatgagatttgtcgaaaattccctgatgtggcaatgcaagggatacaaggagacttttcaaaagatactgcgcaaaaagtaaatgctgttttgcaacagctgatacgtaaatataatctttatctttttgatcaatatggagaaaaaacgattgcttctcgcttagactattggcagaatatgaacctatcaatagaagaaatgatccagttagttaaagaaaaatatgattccattgataagaatacaagacaaccgatatcagaacgactgtatggattgctcacagaactccaagaacaaaaaagaaggcagcaattgttagagttcaatgatgtactccaaaatttgaaaagcgctttggagaatgacgagattcagcgctatattggacagaaatatgattatctatttattgatgaatttcaggatactaatccacttcaatgggaaatcgtgaagcggatgacaaaggaaaacgggatcaagttaatcgttgttggagatgatgaccaaagtatctatggattcagaggatcagagccagcatatatcaagaactttgaaaaagaatatcctactaaaactcttttcttattaactaattaccgctctcgggcagctattgtccaaggagcgaatagattgatcagctataacaaaaatgatcggataccaaaggcgatgattccagcacaaaaagaagcgggcattatggaggcttatttgttctcagatacaaaagcagaaagccagtggctgataagtcaaattcagtcatttattcaaaaaaatgggaaatataaggaatcgatcatattataccgatcggcttcgcaaacacagcaacttgtccaatctctgctgaaaacgaatattccttttgtactggaagcagatagtccatatgaaggtatctttggcatcaagtttttccaacagttctatcaaaaaatcgttcattggcaaacagcacagaatccgcaaaagaaaaatcaggcctatcagcagttgttgcggcagctgatggtagactgctatctgaaaaaaaatgaatgtgatcaatacttttctcctaaatatcaaaatatagccattacggattatattttgtcggtaagacctaatttaaaatccaaatctgcagaaatccgccagtttgaggaagcgttgcgtaaaacagaccagcatcaagaaatctattcgcttgtacaaagctatcttcatctgccacgtatagctaaggaaatcgatcagagtgatcaagaatggatacgagaagaagtaaagcaacatgctacttttagaagtatccaaaccttatcgcaagaaatccaagcaacagctaaagaattaaaaacccgcttgattgcttacagacaaggaaaacttgatgcgctatgtatccagagcattcataaaagtaaaggtcttagttacagaaatgtctttttaattggctgtaacgaaggaagtttgccttataacggagcaacagaaaagaaagtcattgactctaatgaaataaaagcagaaccagcgacgacgatagaagaagaacgaagactattttatgttgcgatgactagagcaagaaatcgtctgtatctatgtgtacctcaaatgaaaaatacaagaaaattgaaagtatcgagatttgtcaaagaaaccggtagtcgtatgaaaaaaggaaagtgatggaaaagaggttgtgacaggagtggtcagcttcaagaaataagaaggaatttacggaaattgcttctcaaatttttgtaaaatttcggcttattttcgaagaagctacttctggaacaccgtttattcggaaaagggaggtgtgacaagatttttgtcacacctcccttatttatttttgaaaaatgagaatactattattaaaatagggaataaatagaataattctcattatttaaacgcaaataatcgattttttttcgactttttttattttttattagctaataattggtattttaaaagaaattgctgtagaattggattataattaaaaaggagtgagaaaatgataaaagtatatacttcgcctagctgtacttcctgtagaaaagcaagagcatggttgcaagcaaatcaacttgaatttgaagagaagaatatttttgccgaaccgttaacagaaagtgagatcaaaaagatcttagcagcgactgaaggaggagttcaagatattatttccactcggtcgaaaatttacgagaagttgggaatagattttaacgaattaactttaaagcaaatgatcgtcctattcaaagaatatccttcattattgagacgacctattttgattgatgaaaaaagaatactaatcggattcaatgaagatgaaatccggtcatttgtccctcgtgaaattcggtgtgttgctagaaacctaatctatttacaaaacaataacatcttaaattcatagggagggagtcttcgtggaagtgaaagtctatggatcggcgcactgtgtaaccagtctgaaggcgaaacaatggttagaataccatcaattgccttatcaatttgttgacttagaagaacgcgatctaagtacagaagaagcagaagaattatgcagttttgaagaagtgcaagcagaacagctatttgcgacttggtctgaggctttccataacattgcgatagacctttcctctgtaggtaaaaaaacaactgatttctttatgtacacaacatacaaaactccttagacgtccgttgatcattatcgatgaagttctatttattggatacaatgagcagttgatggagcaacttatcctaaataaatagtctttacctattttaatcaatttctgagcgcttcgtacagttggaacagtcgaacacttaacatcaagtgtgttatgtgttcttttttttgtctttatttttctactataaaagatatgctcgatttatttggtcaaaattcaaatgtacgagggaaaataggctgagaaatatattgacatgtgtaaatttacatgatatattcatttttgttgttttaagtaatacgcaaataaagcagcattaaaaaaacttgaaaaatagttattgacatgttgatgatgacatgataagataactgagtcgttaaaaaagaacagcttacgaagcttgattctatcgaaaaaaacttcaaaaaaagttcttgacaaataacaaacaacaagttatgataaatgagttgttgaaatgcccagatcgaaaattttttacgaacggggctttatttggtgtgccttgattttgtcgctttcgtttatgagctatttttcttacaccttttacttgactaatcgtaggaaagaggctgggacagaagcgtttaactccaagaaataagaagaaattcacgaaaattgcttttcaaatttttgtgaatttcagcttatttccgaaggagttgcttctgcttccgccgtttatacgtgtttagagcgtgagacaaaagtgttctttacttttgtcccacgctctttaattattatgttcaaaatttgtttacacggctaatgtagcgcctaattcatgttttggaatcgagatctcaacaaggcctgccaattcgattactttgatttcatcctcgtggtaaacggcgtctttgattttatctaagaaataatttttagcatcttcgatttctttcggctggattttacgtttgtcattgatcagcagaatttcattatgttcaggggcttcagtgtagacaatagtggtatttccggctgtgtagaccttgactagatgggcatcagtgttttcaagctggtttaatacaagacgggaatggctgtttgttacatttaccaatttcatggcgctcacctcttttatgtatttttaattgcttgtttctcttattataatttcttttttataaaatgaacagtattttgacttttctgaaaaaagaatgagacggcatttctcaaagaaataccgtctcacgctataaaactggatttattcagccgtttcttcggctgattcttttgccaaacgttctggtttagaagtaacgatgatttttccatctttatccagttttgctttcaactcatggatagaagggtgatcaagataaaattcagcgataccatcttcgatttgttcttggatcgtgcgtcgaagaggacgagcacccatagctggatcatagcctaagtcaactaatttttctttgacattcgtaggaacttcgatgtgaagttgctgtgctgccagcatttggttgacatcgtctagcattagtgtgacgattgtcatcaagttttcttttgataatgcactgaattcgatgatcccgtcaaaacggttcagaaattctggtgtaaagtagttgtttaattggttcaatacagaacgagtaacaccttcgcgtgccgcaccaaaaccaacgtttgcttctactttaccagttccggcattacttgtcataatgatgatcgtatctttaaagctgaccgttcttccttgtgcatctgtcaatcgaccatcatctaagatttgcaagaacatatgcaaaacatctggatgagctttttctacttcatctaacaagacaagactgtaaggatttctccgtactttttctgttaattgaccagcttcttcgtatccgacataacctggaggagaaccaatcaatttagagacactatgtttttccatatattcagacatatcgaaacgaatcattgaatcttgtgaaccgaatagttcgtaggcaagttgtttcgcaagctctgttttacctacaccagttggaccaacaaataagaaggagccgattggacgattctgtttgtttaatccaacacggtttcggcgaatcgctttcgctactcgatctacagcgttatcttgtccgatgacatgagctttcaagtcatctgctaagtttttcagttgtgtctgttctttttcttttaattcacccactggaatacctgtccgttgttcaacgattttttccatatctttttcggtaatcacaggtgtttcctcttcagtgagctgacgttctttcattttttgaagtttattgatctgatcgcgataataagctgctttttcgaaatcttcttctcgagaagctaaaactttttgttcttctgcttcttgcagttttttctcgattgttttaggatcaacgatttggatcgtcaagtttttcttagaacctgtttcatctagcaaatcgatggctttatccggcaagaagcgatcttggacataacgattggataaagttgcggctgcttcgatggcctcatcagtatattttacatgatgatagtcttcataacgtttttgcaaacctttcaaaatactaatcgtttcttcgacagttggttcatctacccgtacaggttgcatacgacgttctaaagcagcgtctttttcgatgatgcggtactcgtttaaggtagtagcaccaaccatttgcaattctcctcgagctaaagctggttttaaaatattaccagcatccatatttccatcaccagcagaaccagcaccgacgatttcgtgaacttcatctatgaataggatcacattttctgcttgacggatctcttcaatcaatttttgcatacgttcttcaaattgtcctcgtataccagtaccttggactaaagatacgacatctaaacgaatgacttctttgtccattaatttttgcggtacatcaccatctacgattttttgtgctaaaccttcaacaactgctgttttaccaacacctggttctccaatcaagacaggattgttcttggttcggcgatttaaaatttcaatgactcgtttgatttcgtcatcgcgtccgatcacaggatcgatatcaccttgtcgtgcttgttctgtgatattgattccatattctcccaataaaccttctgtattgccttgaggtggctgaccaccattgaagttgttgtttccgccaaattgtgttggtggtgtttgctcataatttccttgctgttgcatttggcgagacatggaacggaaaagatcgtccaaactgccaaatccaaatggatcgttttgggccatattagtcagacctccattttgttgatttttgattttttgataacagctctgacaataatcaagttgtgtccgctgaccattgacagtggcatacaagtgaatcgttgcctcattcttgccgcagttttgacaaagcatgaatcattcacgtcctttcacaaaaatgggtacatccatattttacatctcgtttttcatgaggtaaaagaataacccctagttttttaagagatttatgaggtagaaaaggtgaaatttatattgaccattcctgacctttgactcttattatactaaaaataaaaagggaagcaagtaattcgtttcatatgaaaacaaagagggtcaaaggaaagaatgataaacgtcaggagaagagaaagcgacaagaaaaagaaaataaacatgtttgttataaaatgtgaagaaaaggatgaaaaagaatccggaataatttgaatacttttatctgaaattgaatgaaaactgttgtatctaacgaaaaaaaatgttaatctttacagatgaaagggtggcatttgttaggattctctgaattactaaaaaagaaaaccctcacataaaaacaacactcacttaaaggagaccgattaatatggaaaagaaagaatttcacgtagtagcagaaactgggatccacgctcgtccagctacactattagtacaaacagcaagcaaatttaactctgatgtaaacttagagtataaaggtaaatcagtaaacttgaaatcaatcatgggcgttatgtctttaggtgtaggtcaaggttctgatgttactattactgcagaaggtgctgacgaagctgatgcaatggcagcaatcgttgaaacaatgaagaaagaaggcttatctgaataatggttgaaatgctaaaagggattgccgctagtgacggtgtagccgttgcaaaagcttacctgctagttcaaccggatttaacattcagtaaggcaacagtagaagatactgcggctgaagaagctcgtttggatgctgcattagctaaatctactgaagaattgcagcaaattcgtgaaaaagcagcgcaaagcttaggtgaagcagaagcgcaagtatttgatgcccatttgatggttctttcagatccagaaatggtaggtcaaatcaagcaaaatattaaagacaacagcgtaaatgctgaatcagcgctaaaagaagtaacggatatgtatatcggtatgttcgaagcaatggaagataatgcttatatgcaagagcgtgctgcagacattcgtgacgttgctaaacgtattttagcgcacttattaggcgttactttaccaaatccatcaatgatcgacgaagaagtggtcgttgttgcacatgacttgactccaagtgatacagcacaattagatcgcaattttgtaaaagcgtttgtaacagacattggtggacgtacttcacattctgctatcatggcacgttctttagaaattccagcaatcgttgggacaaaagaaattactgctaaagtcaaagaaggcgatattttggctgtcaacgggatcgaaggcgatgtaatcatcgatcctacagatgaacaaaaagctgaatttgaaaaagcaggtgcagattacgcagcacaaaaagcagaatgggaaaaattaaaaaatgcagaaactgtcacagctgacggcaagcattttgaattagctgcaaacatcggaacaccaaaagatctagttggtgtccataataatggtggagaagcagttggtctgtaccgtactgaattcctgtatatggattctccagacttcccaacagaagatgaccaatatgaagcttataaagctgtattagaaggtatggaaggaaaacctgtagttgttcgtacaatggacatcggtggagataaagaactaccatatctgcaattacctcatgaaatgaatccattcttaggatatcgtgcattgcgtatcagtttatctgaacaaggcgatgaaatgttccgtacacaaatgcgtgcattgcttcgtgcatctgttcatggtaacttacgtatcatgttccctatggtagctacactcaaagaattccgcgcagcaaaagcgatctttgaagaagaaaaacaaaaattgatcagtgaaggcaaggaagtatctgatacgatccaagtcggcatcatgatcgagattccagcagcagcagtcttagcagacaagtttgcaaaagaagtagatttcttctctgtaggtacaaacgatttgattcaatacacaatggcagcagaccgtatgaacgaacgcgtttcttacttgtaccaaccatataacccatcaattttacgtttgatcaaaaatgtaattgatgcagcacacgctgaaggaaaatgggcaggtatgtgtggagaaatggctggagatcaaacagctgttccattgctagtaggtatgggtctagatgagttctcaatgagtgcgacatctattcttaaaacgcgtagtttaatgaaacgcttggacacagcgaaaatggctgaacttgctgatcgtgcattgaaagaatgcgatacgatggaagaagtcgttgaacttgttcatgaatatgtaaaataaacaacgtatcaaaagctggtgtggcttgtaaaagagctacgccagtttttttgttcttttttaagaaaacgttttcttcagtaagaatagacaaaaatagggcttaagtttgagtgacagtttgtaggctatgttatactatataagtgaagggggacgtaaggtgaaggtattattatattttgaaagtgaaaagatgcttgcaaaatctggaatcgggcgtgcgcttgatcatcaaaaacgtgctctgacggaagtcggtatctcttatacactagatgaaaaagaagattatgacatcctgcacatcaatacatacggaatcaatagtcataacatggtcaataaagccagaagagaaggaaaaaaagttgtctatcatgcgcattctacagaggaagatttccgaaattcctttatcggatcgaaccagctttctcctatcgtaaaaaaatatctggtaggattgtaccaaaaagcggactatctgatcacgccaacaccttattcaaaacagttgttggaaagctatggtatccgtgtgccgattcaagctatttccaatgggatcgacttagagaaatatcgccctgatccaatgaaagaacaaaagttcagagaatatttcaaactgtctccggatcaaaaagtaatcatttgtgtcggtttgtttttcgaacgtaaaggaatcattgatttcgtagaaattgctaagaagatgcccgaatacacatttatttggtttggccatgttcccatgtactcgattcctcggaacatccggaaaattgtaaaagaagatcatcctgaaaatgtcctgtttcctggatacattcgtggagagatcatagaaggtgcgtattcaggtgcagacctattctttttcccttcttatgaagagacagaagggatcgttgttttagaagctttagcaagcaaacaaaacgtacttgttcgagatattccagtgtataatggctggttagaagatagcaagaactgctatatggggaagacaaacgaagaatttatccgactgatccaacagattaccaatcaagaactaccgagtacgacacaagccggttatcaaacagcaaaagagcgaagtatcaataaaatcggtgaagaacttaaaaatatatacgaaagtgtactgaatgaaaaagtctctagcaaattaaaaaaagtaaatcagatcaaggactagtttggaggcgaaaaacatgaaaatcggcttttttaccgatacctactttccgcaagtcagcggagttgctacatcgatcaaaacattaaaacaagaattagaaagacatgggcatgaagtctatatttttacaacgaccgatcctaatgcggataagttggaaaaagatgtgattcgaatgccaagtgtaccatttatttctttcaaggatcgaagagttgttgttagaggcatgtggtatgcttatttggttgccaaagaactagaactagatcttattcatacccatacagaattcggagcagggatacttgggaagatggtagctaagaagttgaaaatacctctgatccatacttaccatacgatgtatgaagactaccttcattatatcggtaaaggaaaagtgatcaggcaatcccatgtaaaatacttgtctagattatttgcaaatcatacgacaggtgtagtttgtccaagtgaacgtgttattgatacattacgcagctatggtgtaatagcaccgcttcgcgtgattcctactggtatcgacattgaaaaattcaaatgttctgatatcactcagcaggatatcagcaaattaagggagtcactaggtcttcaggaaaaccatttgatgattctttctttaagcaggatttcttatgagaaaaatatccaagccttgattaatgggtttcctcaggtcatctccgcttatcctaacgccagattagttatcgtaggaaaaggaccttatgtagaagagttagaggaattgatctcagaactgcagttagaagaatttgtgcagttcacaggagaagtggacaacaatgatgtagcactttattataaagcggcagattattttgtcagtgcttctacttcagaaacacaagggcttacttatacagaagcgatggcagccggaacaccttgtgtcgtggaaggaaatgcttatttgaaccgattgttcgatcatccttcattagggaaaacttttgaaaccgacgaagactttgcaccagcacttattgattatatttccagtgaagttcctaaagatacaaaagttttagaagctaaactttatgatatttcatctacacatttcggcgaagctatgatcgaattttatcaagacatggttgtttatcatgaagaagagatgcgaagaaaagaagaagaagactcgattgaacgaatcaaaataaaattaaattcatttaaaagataaaattcaaacattttttatgaaaaaatccttgtttctagcgtatactagcatagaagcaaggatttttgatttttaggaggtcgaaaaaatgaaacttggttttatcggaacaggcgtcatgggaagtgctgtcgcacgccatctactagaagcaggacacgaagtagctgtctataatcggacaaaagcaaaagctgatcctttagtaacagaaggagctatctgggcagatacaccaaaagcggtagcagaacaaagtaatattctctttacaatggtaggttaccccaaagatgtagaagaaatctactatggacagtcggggattttttctgcagatatctcaggacatattttagttgacttgactacaagtacaccaagcctggcagaaaaaattgcaaaaacagcaaaagaaaaaggcgcagatgcgttagatgcaccggtatccggtggtgacttaggagcaaagaatggtacactgacgatcatggtcggtggagaagaagccgtttatgatcaagtactgcctttattcaaagaatttggtacgacatttacattgcatggttctgctgggaaaggtcagcatacaaaaatggctaatcagatcatgattgcaggtacgatgacaggaatgacggaaatgcttgtctatgcacaaaaaaacggacttgatttaaagaaagtgattgagacgctttcaggtggaagtgcagctaactggtctttaagcaattattctcctcgtattttaaaagaagattacacacctggtttttttgtcaaacattttatcaaagatttaaagattgcattagaagaagcagaaaaaatggaccttgtattgccagcaactacccaagcattgaaactatatgaagagttggcagataaaggttttgagaatgacggaacccaagctttgatcaaactttggtggcctgaaggaaaaataccagaaaaaaaatcataaaaaacgagtttttttagagaaaatcaatgcaagtaggctatgcttttgatacaatataacagaaataagaaaaggaggacctccgatgacacattcacaattagtcgcaatcataaaacgactggaggctatggtcgagtcagcagataatgaactgcaagttcgccgttttgaaaaagaaggcgtagagaagtgtacagtaacttatgataaagcgaccgatacatttgaattaactgaaacagatactcatcagcaatacgaatttgataatatcgatatcgtagcgatggaaatctatgacttaatccaataaattttaggataattgacatttgaagttgaagatgcctaaaagaagccgataagcaactaatttagttgcttttcagcttcttttttgtttaacagttcaatttcagactgttctttttctaattttttgcggtaactgatcaagatttgtacaggatcgatttcttcttttgataattgacgtttcaaagataaatgagcttctttcttttcataatagaagtcaggagaaacgtcaccagaggcaatcattgtttctacaagttgaccataacaaacgaggtagtgctttttctgactctcatctgctgctaatggcatgctgaaggtgagcgatggtgttcttaaaaactgcttttgttcctggatccgtctaataaaataagtaactaattcgatatctttttgaagcataccggctttttcgaaattcaactgatagatgaaatgttgttgtctttttttcaagtaagtcagtagctttttgtttcggccttgaaacagcccttggagttccttttttttctgttcaaaagtcatttcctgtaggtcaggaagctggacacacaaagctaacaaactaatttcagacaaccaaggcatttgataagtttcttccattatacgcaaaatagacggcatttttttatagagacgaaaaggcccgtatgttcgagccgtaggagtatctgttaatacaaatcccttattggtaatatgtacataattataattactgaaataattcatttgtcggttataaaaaggtcggtaatgttggatcaattgacactcgagcaataaagcatctaattccgtgtctactacgacgaaatcaaaatctgttatatgatgaatcatgcgtaatacttttttcgaatgctgtttattctgatgaaaatagctgcttactctatttttgagccgttttgctttaccaacatagatgaccttaccatctcggtctttcataagatagacacccggcagcatggggagagttttcattttttcttttaacataggatctccttttacgctttgaataaaaagactataacaaattttgaaataatggacaagttttagggaattatatagttctgttcacagaaaatactttgataatcaaaatatgtgagatagatgatttttctaataaaagaaattataaatgctgatttatcagttgttttaaatgagtaaaatcttaaaaaaagctcatatagtaaaaaaatgatcttttaaggttgcattttgaaaaaagttaagatatagtttgaacatcaaaagatttgataatcaaactaattagtggacggtggaacatggaaccagatttaaaaacagtaaatgattatcttgttagtgtcttcaatgatattttgacaatcgaagagtctgagctgaaaaaatctcaattcaaagatctgtcaatcacagagatgcacacgatcgaggcaatcgggatgtacaagaaaaaaacaacttcagaagtagccaaagaactatcaattactgttgggaccttgaccactgctattaacaagttagtaaaaaaaggctatgtcgaacgtatccgcagtgaagatgaccgccgcgttgtaaagttgggactaacgaaaaaaggaaagttactatttcgggtccatcagcattttcatcgtgaaatggtcaagaacatcttagacggaatggctacggaggaacagcatgccttgctggatgcactgaaaaacttgcacgacttcttgcaagactataagtgaggatatttaatggaacaatttggaatgattactgcaacagccagcgtccttcctgaaaagattattactaataatgatctttccaagatgatggatacctctgatgaatggatttcgtcaaggacgggtattcgtgaacgaagatgtgtaacaaatcaggagacttctgatttatgcattttagtggcggaaaaattgataaaacagaaaaatctaaaccctaaagatttggattttattttagtagcaacaatgtcgcccgattacacgacaccatctgtagcagcacaagtacaagggaaattgggagcaactcatgctatcgcttttgatatcagtgctgcgtgctcaggatttgtttatgcgttaagtatggctgaaaaaatgatccgctgcggctcaactaagggactggtgattggtggtgaaacactatctaagctaatcgattggtctgatcgtacgactgctgtgttgtttggcgatggagcaggtgggattctcttagaagcgaatccacagaaaaaattgctgaaagaaaaattagcagctgacggaaccagaagtagctcattgaccgctggctaccagcaaaataaaaatccgttctattcagaagattcagaaggttcgtattatttgcaaatgactggcagagatatttttgattttgccgtacgagacgttgcaaacaatatccaagaagtcatgaaagacaaaccagttgattatctgcttttgcatcaggcaaacctcagaattattgagaaaattgcccgaaaagtaaagatgccgcaagaaaagttcctgaccaatatggataaatatgggaatacatctgctgcaagcatccctatcttattggatgaagcagtttctagtggaaagatcaccttgggaaaacagcagaaagtaatatttacaggctatggcggaggtttaacatggggaagtattctcatggagttgtagactgttaaattataaaaataaaaagcaaacaatatcggaggaatatattattatggtattcgaaaaaattcaagaaatcatcgcagaagaattaggaaaagaaactgaagaaatcaaattgactactgacatccaagaagacttagaagctgacagcttggatttattccaaatcatcaatgaaatcgaagatgaatttgacgtgaaaatcgaaacagaagacggaatcaaaacggttcaagatttagtgacttacgtagaaaaacaaactgcataatcattaaaattaggttgggggctgggacatttcctgaaataggaatgtctcggcctttttgaataaaaagaatcaaacatatattctggatatattggagaaaaacatgaaaacagcattcttatttagtggccaaggtgcacaatatcaaggtatgggaaaagatttgtatgaagaagtcattgtaaagcagacatttgatgaagcaagtgaaattcttggctacgatatggctgaactttgctttacagaaaatgaacatttggatcagacgcaatatacacagccagctattctaacagtcagcatcgcatattatcgcttattgaaggagcacggaatcatcccagatgcagctttaggactgagtttaggagaatattcggcattagtagctagtaatgcgttatccttcactgaagcagttgcgttagtagcaaaaagaggcgcttatatgacagaagcggccccagctggaagcgggaaaatggttgcagtgatgaatgcgccgattgaaacgatcgaggaaagctgtcatgaagctagtaagtacggcatcgtatctcctgcaaattataatacacctcagcagatcgtgattggtggcgaagaaaaagcagtagacgaagctgttttactattaaaagaaaaagggttcaaaagaatgatccctctaaatgtcagcgggccttttcatacagctattttagaaccggcagcaaaaaaactggcgaaggacctaagtcagattcaattctctgaaccttcttttcctatcataagcaacacaacaacggaaataatgaagaaagaaacgatcgcgggactacttgaacagcaagtcatgcaacctgttcgtttctatgagagtatccataagttaaaaacaatcggcatcgagcaagtcatcgaagtcggccccggaaaagtattaagcggatttatgaaaaaaatcgataaaacaatatcagttctgcgtgttgagaataagcagacatttgatgaaacaatagcaatactataaggaggaacgttatggatgtaaaaggaaaaaatgtatttatcacaggtagtacaagaggaatcggcaaagcgatggccttagcttttgcaaaagctggagcaaatatcattttgaatggtcgcggagagattccaaaagaaaagatagaagaaatcgaagcattcggtgtaaaatgcgtaggagtttccggtgacatctctgattatgagaaagcgggacaaatgatcaaagaatcagaagaaaagcttggatcgatccatgtgttagtaaacaatgccggaatcacaaatgacaaacttgtgatgcggatggatgcagaagatttcaaaaaatgtcttgatatcaatttgattggaaccttcaatatgacgcagcacgtattgaaaaaaatgatgaagcagcgagaaggggccatcattaatctctctagtgtatctgggttgattggaaatattggtcaagcaaattatgcagctagtaaagctggcgtagtaggattaacaaaatctgtggcacgagaagctgcaactagaggcattacatgtaatgccattgcgccaggattcatcacaactgatatgacggaagttttagcagacaaagtcaaggaacaagcggaaaagcaaattccgatgcagcgtttcggacaagtagaagatgttgcacaaacagcagttttcttagcacaaaatccatatatcaccggacaagtcatcaatgtcgatggcggattggtcatgcacggataagaaaaggagagcaaataaatgaatcgagtggtaattactggctatggagtcacttcacctattggaaatgacgcagacagctttttgaatagcttaaaagagggtacgaatggcatcgcaccgatcactaaatttgatgcttcagaaacagggattaccttagcgggcgaggtcaaagattttccttacgataaatattttattaaaaaagatagcaaacgaatggatatgttttcaatctatggaatctacgctgctttagaagcaatggagatgagcggtttagataaagaaaaaatgaatcaagaccggtttggcgtcatcatcggatctgggatcggtggtcttccaacaatcgaaaaccaagttattcgtctacatgaaaaaggtgcaaaacgagtttctccaatgttcgtgccaatggcgattgccaacatggcagctggaaatattgctttgcgcgtaggtgcaaaaggtatttgtacagctatcgtaacagcttgtgctagcggaacgaattcaattggggaagcattccgtaacatcaaacatggctattcagatgtcattcttgctggaggaacagaagcaacgatttgtgagatggggattgctggatttgcagctttaacagcactctcagaatcaactgatcctaatcgtggttcgattccgtttgacgaaaatcggaatggttttgtgatgggtgaaggagcaggtgttctagttcttgaatctttagaacatgcacaagctcgcggtgccaaaatctatggagaaatcgttggatacggtgcaaactgtgacgcttaccatatgacagctcctactccagatggttctggtgcatctaaagcaatgaagcttgcgatggaagaagctggtgtacagccggaacaagtcggatatatcaatgctcacggaacaagtacaccagccaatgaccaggcagaagcaaaagcaatccaaatcgcattaggtgaaaatttcagagatacttacgtcagcagcacgaaatcgatgactggacatttattgggagcagccggcgggatcgaagccttggcaactttgctggcattagaacatcaatttatcccacctacgatcaatgtagaaaaacaagatcctgagattgacttgacagttgtcaaaaacgaaagcaaacctgcaagttttacttatgcaatgagtaattcattagggtttggcggacataatgcggttctgtgcatgaaacgctgggaggaataattttggatatcaatgaaatcagagaattagtcagtcaatttgatcaatcctcgctaacggaattcgatttgcgtgaaggtcaatttgaattgtatatgaataaaaataaaacaagtcgaggcatgaatatggttcaaacaaacgaaacgttgccagtttcggagccagtcaatgtcatacctgaacaagcaacaactgctccagaaacaatgaaagaaaaagaatcggcagtatttgatggaatcgaggttgtttcgccaatcgtgggaatcgtttatctgcaaccggcgcccgacaaaccagctttcaaaaaagtaggtgatcaagttgccaaaggagaagttatctgcattattgaagcgatgaaactaatgaatgagataactagtgaggccgacggagtaatcacagaaatccttgtagaaaacgagtcagttgttgaatatggacagccactctttaggatccagcaaaaataagcaaagcaggaaagagggaaatcaatgaacatacaagaaataaaagaaatcattccacatcgttatccaatgcttttgattgatcgagtggaagaaatggttgaaggagaacggatcgttgctaagaaaaatgtaacgatcaatgagcccttttttcaaggacattttccagaagaacctgttatgccaggagtattgattgttgaagcaatggctcaagcaggagcagttgcattactttctcttgaacaattcaagggaaagacggcttatttcggcggattggacaaagcaaaattccgtaagaaagttacaccgggagataccttataccttgaagttgagatattgaaagtgaaagcttcagccggaataggcaaaggaatcgctaaagtagacggtaaaaaagtagccgaagcggaattaacctttatgattggataggtgaaatatgttttctaaagtattgatagctaaccgcggtgaaatcgctgtacgtatcattcgtgcatgccgcgaactagggatccaaaccgtagcgatatattcagaagcagatgccgaagcacttcatacacagttagcagatgaagcaatctgcattggcccggcaaaagccgttgattcatatctgaatgttcaggaagtactgagcgctgcaatcgtgacaaaagccgaagcaattcatccaggatttggttttttatctgaaaatagccgatttgcctccatgtgtgaagagtgcaatatcacatttattggtcctaaaagtgcaacgatcgatgcaatgggaaataagatcaatgcgcgtcaattgatgcaagaagcaaatgtcccagtcattccaggaagtactggtgtattatctacagtagaagaagcattggaaatagcagacagaattggttatccagtgatgctgaaagcagctgcaggtggtggcgggaaaggcattcggaaagttcaatcaaaagaagagctcccacagcatttttcttcagctcagcaagaagcagcagcggcatttggaaatgatgatatgtatttggaaaaaatcatttatcctgctcgccatatagaagttcagattttaggtgatcattttggcaatgtcattcatttaggagaacgagattgttctttgcaacgtaataatcaaaaagtactggaagaatctccttctgtagtgatctcacaaacaaaaagagaagcactaggagacgctgctgttcgagcagctaaagcagtcaattatgaaaatgccggaacgatcgagtttctgatggatgaagaaggcgatttttatttcatggaaatgaatactcgaatccaagtggaacatccagtaacagaaatggtcacaggaatcgatttagtaaaaaaacaggtggagatagcagccggcgagcctttgaatgtgtgtcaagaagaagtagtattccaaggacacgcaatcgaatgccggattaatgcagaaaatcctgctttccattttgctccttctccagggaagatccaaaacttactgcttccagcaggtgggatgggtctgcgagtagacagtgcagtttacccgggatatacgatcccgccatattatgattcaatgattgcaaaaataatcgtccatggaaatacgcgttttgaagcattaatgaagatgcagcgagccttaagtgaatttatcacagaaggaatcatcacgaacgcagaatttcagatggatttgattagtcatcctgcagtcatagcaggtgattacagcacagcatttttacaagaagaatttttaccgaattggacaccagaaacggagataggaggcgcatagatggctctgtttaagaaaaagaaatatattcggatcaatcctaatagagagagcaaacctgctaactcgccatctgttcctgataacatgtgggcaaagtgtccaaattgcaaacatatcctttatacgaaagacatcggtgaagaaaaagtatgccctcattgcggatacgcttttcgaatcggtgcatggcagcgtctagctttgattattgatgaaaaaagttttgaagaatgggatacggatcttgtaaccaaagatccgctagcatttcccgaatatacggaaaaaattaaaaagatgcaagataaaacaggacttcatgaagcagtcctcactggtaaagcaaccattcaggggattcccttcattattggagtgatggatcctaattttatcatgggaagtatgggaacgattgtcggagaaaagatcaccagattattcgaacgagcaacaaaggaaagacttccagtcgtcttgttcacagcttcaggtggtgcacggatgcaagaaggaatcttttctctgatgcagatggcaaaaatttctgctgctgtcaaacggcatagtaatgaaggtcttttttatctaactgttttgacagacccgacgaccggaggagtaactgccagttttgcaatggaaggtgatatcattttagcagaaccccaaagcttgattggttttgctggaagacgtgtcatcgaacagacgatcaagcaggaacttccagaagatttccaaaaggctgaattcttattgtctcatggttttgtcgatcagattgttccccgcatggaattaaagcagaaaatccatacgcttcttgaattgcatacacagaaaggatggatagatcgtggataagacagcacatgatgtcgttcagttagcaagagctaaagaacgatggacaagcttggatttttttgaagagatcttcgattctttcgaggaatgccatggtgatcgtttatttgcagacgacgaagcgattgttggtggaatcgctcgattagatggcaaaccggtaacagtgatcggtattcaaaaaggacgggatctgcaggaaaatatccgcagaaattttggttctccccatcctgaaggctatcgaaaagctttacgactgatgaaacaagcggaaaagttcaatagaccggtgattacattgatcaatacagcaggtgcatattgcggtgtaggagcagaagagcgcggcgaaggagaagctattgccagaaatctgctcgaaatgtctgatttaaaggtaccgatcatcgccatcatcattggtgaaggtggaagtggcggtgcccttgctctaggtttagcggatgaagtctggatgctggaagaaacgatttatgctgtgctttctccagaaggatttgcgtcgattttgtggaaagacggtagtcgcgccgcagaagcagctgagttgatgaaaattactgcgccagaactacgcgagttaggaatcgttgatcgagttattcctgaaacgttcaacggcgagcagttgccacgatataaagtcgcacacattatgaaaaaagcgttgattgaaagattgacggaacttgttcgattcgaccagcatgaattactggaaaaacggtacaagaggttccgccaatattaggtgtttaacaactaagcaaagagtaaagaatggttcttgctcgcttagttgttttttgtttctaaatttttctgtgatcaatctttatttttggtcattttgtaaagaaatgctttttctgaaagacgaacgagtatagaggtagttttttttgctgatatgcagtataatacggggttgaggagtactttatgtgctccttcattttttgcagatgaggagacagcatgttttcaaattacaaaccaacatggatggtagaagccatctatcagattacacctgcccaattaaagaatctaggcatcaaagcagtattgaccgatttagacaatacgttgattgcatggaataatccagatggaacagaagagttgcttacttggattttagaaatgaaaaatgcaggaatccctgttgttgttgtttcaaacaataattcaaaacgtgtcgcgcgagcgattgaaaaatttgatcttttgtatgttgcacgagcaatgaaacctttagcaagagggatcaacatagcaaagaaacaattggatttagcagatgatgagatagtaatggtaggcgatcagattatgactgatatacgtggagccaatcgtgcagggatacgtagcatccttgtaaaacccattatcgcaacagatagttggaagacacaatttaatcgttttttggaaaaaagaattatggcctatctattagcaaaacaccctgatatgggctggcgaggtggaatcgaatgacagaagaattacaatgtatcggctgtggtgccgttatacaaacaaacaaacccggtgaattaggatacacgccgcaaacggctttggaaaaaggtttagcttccggggaagtctattgtcagcgttgtttcagattacgccattataatgagatccaagatgtctcattgacggatgacgactttttgcgcttactgaatgaattagggcaaaaagatgcattgatcgtcaatgtggtggatatttttgacttcaatggttcactaatcccaggactacaccgttttgtcggtgacaatccagtacttttagttgggaacaaagtggatatattacctaaatcattgaaaaaaactaaattaacacaatggatgaaggaacgtgcttacgaagcaggaattcgtccagtagatgtattattaactagtgctaagaaatctcatgagatgacggaactattagaaaaaatcgaagaataccgcgatggacgggatgtctatatcgtcggggtaacaaatgtcggaaaatcgacgcttatcaatcaaatcatcaaaaatacagcgggagtacaagatgtaatcacaacttcgcagtttccaggaacgaccttggataaaatcgagattcctttagatgacgggcattttttgattgatacaccgggaattatccatcgccatcaaatggcgcactacttaggtaaaaaagatttgcggatcattgcaccgttaaaagaaatcaaacctaaagtttatcagctgaatgaagggcaaacacttttcttgggcgggcttgcaagatttgattttatcagcggcaatcgtgcttcatttattgcttatgtgtcgaatgatgttaatattcatcgaacaaaactggaaaaagcagacgaattttatcaaaaacacgtaggtgggttattgcagccgcctcgtcctaatgaagtcgaggaatttcccgagcttgttcgttttgaattttccgtgaaagaaaaaacagacatcgtttttgccggtctaggctggatcaccgtaacagcaccagcagtaattgctggctgggcgccaaagggtgtagatgtcttgaagcgaaaagcattgatttaaggaagaaggaaaattatgagtttaagaggaaaacaaaagcgttttttacgtagccaagcgcatcatcttcagccgatttttcaaatcggaaaaggtgggatcaattcagcaatgatcgttcaaattgaagaagctttagaaaaaagagaactgatcaaagtatcgttacttcaaaatacagatgagattgcagaagaagcagctcaagtattagaaaaagaaatagattgcgaaatcgtccaaatcattggacgtgttatcgtattatacaaaccttccacaaaagaaaagtatcaaaggctatcaaaagaagtaaaagcaatataaggagtgaccatgatgaatacgcaagctaagacatttgttcgttcacaattatttcctgaagaaatgcctcaattcctagagaagaaaaagcaagtagggatcttgggcggaacatttaatcccgttcaccttgcacatttagtgatggctgaacaagctggccggaatttaggtcttgaccgcgtatttttgatgccttcttatcagccacctcatgttgatgagaaacagacgattgatgcaaaacatcgactcaacatgttggaattagctgtggaagacaatccttttttgcagattgaaacgattgaattagctcgtggtgggaaaagttacacctatgatactatgaaggaattgacgcaaaacaatccggatacagattattactttattatcggtggggatatggtagaatatttgccaaaatggtataaaatcgatgagctgacttctatggtcaactttgtgggtatacgtcgaccaggatacacaacggatactccatatcctgtaatttgggtagatgtacctgagatcgacatcagttccacgaaaatacgtcaaaagatcaaagaaggctgttctatccgctaccttgttccagataaagtaattgattatattcaaaatgaagggttgtatgaatatggactatagtaatgaatatactgcttattctagagaaaacctgatgcaaaaaatacagatgagaatgagcgaacaacgcttcaagcatgtgcttggagtagaagaaacagccgtggctcttgccaaaaaatacggtgcttctcctgaaaaagctagtattgctgcattgacacatgattatgcaaaagaacgaccagatgaggagttcaaaatggtaatcgtaagagacggttttgatccagagttattgaattataataatgcaatctggcatggtcttgttggcgcttcgtttgtagagcgggaattaggaatcaccgatgcagagattcttcatgcaatccgggtgcatacgactggggctgctaagatgagtctccttgacaaaatcatttatgtagcagactatattgaaccaggtcgagattttcctggggtacaagatgcacgagccattgcatgggctgatctagacgaagctgtagcatttgaaacaaaacatacattggcccatttgcttgcgcaagaacaacagatttatccaaaaacaatcgaaacatataattactgggtagcaaaaaaataagctgctcatattaggaggaaatcatcatagatagtaaagaacaattaaaaattgcggttgaagcagcagattcaaaacgggcagaagacattatcgctttagacgttcgaaatgtttccttgttggcagattatttcatgatctgttcagcaaatagcgaacgtcaaatcaacgcaattacagaagaaatcattgataaagaagaagaaaacaaatatgaagtaaaacgtattgaaggaaaagaaggcggaaaatgggtattgatcgatcttggagatttgatcgtacatgttttccatgcgccagaacgaagtttctataatctggaaaaactatggtcagatgctccgctagtcgatcttagtgaatggttggattaacatatggcttatgaaacatttgctttcatttacgatgaagtgatggacgaaacactttatcagcaatggctagctttttcgaaacgtcatttacaagaagacacaaaaaatattttggaactggcatgcggtactggagcattagcggttgcctttgcaaaagatggatataaagtgacagggttagacctttcagaagagatgttgatgattgccagccagcgagcatatgaagaagacgcatcgatccaatttgtggaaggcaatatgctcgatttatcagaaatcggacaatatcaggcaattacctgtttttctgattcgctgtgctatatgaaaaatagacaagaggtacagcaagtgtttgatgaagtctatcaagcgttagaagaaaatggccgatttttatttgacgtacactccacctatcaagtagatgaggtttttccagaatatagctatcattatcaaggggataattttgcttttttgtgggatagttatccaggaagcgagaaacacagcatcgaacattttcttacctttttcgttgaagaacaagaagggtctggtcgatttattcgtgaagatgaactacatcaagagcgtacctatccattggaaagttatttaagaatgctggaaaacagcggcttttcgaaagtcgaagcattttctgattttacagacgaagcagcatcagagaaatcaaagcgctggttctttgtagcatacaaagactagcggttttgcctgctcgagttaacaagaaaagaataaatcttcaacataaattatatatccgaacgatataggcattgctcttgcagtgcagcttttcgtcgcagaagtattgtgtttgcgagaatagtttatatagttcgggtattttttccgatttttgcctttttttacttgtctctatttcttttttatcgataactatgaaggaggatgcgcatgaaaagctgcgggattatcgtagagtacaatccttttcacaatggacatcgctatcatgtggaaatggcacgaaaaacaacaggagcagaggtcgtcattgctgtaatgagcgggaattttttgcaacgaggcgaaccggctatcatcgataaatggcatcgcgcgaatgaagctttacaaaatggtgtggatttagtagtggagcttcccgtcgaatgggcggttcagtcagctgactattttgctaaaggtgcagtaaaaatcttgcaaacactggactgtgacagtttgtgttttggaacagaagaagagacttcgtttgattacagcagtttcggacgctttgtccaagagaatcaagataggatagaagaggcatttcaagaactgtctgatcaaacgtatagttatccgcaaaaaatgactgaggtttttcgcagtctgtatcccgatattgtgcttgatttttcttcgccaaatcatatcttgggattaagttatgcaaaggaaaatgccaagtatgtccaccctatggaattacatccgatccgacgtaaaagtgcaggctatcatgaaaaaatcatcacagatcagacgatagccagtgcaacagccattcgccatgcgttagaagaaggaaaaaggatagctggacttgtgccgcctcagacagaagaagatctttcaacttgttcgctgcagacttgggaatcttattggccgtatttgcgttatcggttgttatcttctactttgctggaactgacagatatctatcagatgaccgaaggaatagaatcgcgcatgaaaacagcagctgcaactgctgatagttttgaggattttgtgtcaaaggtaaaaacaaaaagatatacatggacacggatccaacgattatcttgttatgtcttgctgaatatcaaaaagcaagagattcctgtccaacaaaataaaaattatcttcgactacttggatttaccgatgttggaagaagattcttaaaagaaaaaaaagagatttctatttattcccgaatcggaaaaaaagaggcacaagaagcggaactgttagttagaagtgatcaaatctatcaattgggaggcaatattccggaacagaatttcgggcgaatcccaatccgagtatagataattgactaaaaatgagaagaatgaaggaagaaagaaaaaaagcttcacagaatcgtgattcacaagtataatggaacaggacgtttttgcgttatgaaactatcaaatcagaaagcgaagtgaaaatatgggacgtaaatgggcaaatatcgtagcaaagaaaactgctaaagatgctaataatagccggatttatgcaaaatttgggattgaaatctacgcggcagcaaaatcaggtgatcctgatccgcatgcaaaccaaaaactacgtttcgtcattgatcgcgctaaaacttataatgtaccaaaacatattattgaccgagcaatcgaaaaagcaaaaggtgcaggagatgaaacatactctgaattgcgctatgaaggatttggaccaagcggctcaatggtgattgttgatacattgacgaacaatgtgaatcgaacagcagcagacgtacgggcagcatttgggaaaaatggcgggaacatgggtgtttccggagcggtttcttacatgtttgacaatacagcaatctttgcttttgcaggagaagacgctgacgagatccttgaatacctaatggaaaaagacatcgatgttcgcgatgtaatggaagaagaaggacaaatcatcgtttacggtgaagtagcggatttccatagtatacaagaagcattaaaagaaaaaggaatcactgatttttcaatcgctgagatccaaatgatccctcaaaacgaggtaacactatctccagaagatcaagaaacatttgaaaaaatgattgatgcactggaagatctagaagatgtacagcatgtgttccataatgtggcattagaagactaagcaaccagttttaacgaaaagtattcagtctttttcgaaaagcaagacaatctcactaacagattgtcttgcttttttgtgtgatttattttcttttctaattcaacctgtggtatgatgagagcataagtatcatgtgaaatgatatgaagtatgtggaagatggacggggaagaatatggaagcaaaaatcactttagaaccttttgaacgtatcttaagcggttaccgcaaagtagaagagttagctgtgaacgtaactgattgttcaaaattagcgcaaaaatacgcaagattcggcgttgaaggctatcgattaggaaactatgtcggtacagggtatctgaaccgttatttagagtgtatggtggaccgcgcaccaatgctgatttatagacaaaaatatttgattccgctgctttttcgtcgttctgattcagcctttcggttatttgaagaagagtatcggatggaggctttctttctactattagagtggagcttgaagcatcgtcctgaaaaaattcttatcgaaagaaatgagaagatagacacgaaaaaaaataaagtgatcgatagtgcatacctagcatttcgtgtatcagagattttggattgtggcggctatccaatcagcaatttccaatcaattgaccaattcattgaatggaatcgaatttaccgattgatcaacaatggcgggattggccgtcatagcaaggtatttgacccagaatatccagaaaacatgggagaactgaaaatgattatttcgcttgtcaaattaaaatatcctgaaacagatttggatttatatatagaataaatgaccttaaatgattgaattactttttctgcaattattattgtaaataaaaagacaactgctaacattaatgatagcagttgtctttttacttacagtacttttttctcataagatgaaatatccatattgtttaacaaaggactttcattattggaggtaaaaagggtcaattcatgcatcgcacgtgtacacatggtgtaaaggatcaatttgtcttgctgagaagaaaaatgttctgcatctacatcccacaagaaaactcggtcaaactccagaccttttgctaaaaaggctggaagtaaaataatggaacgcttcataaagtcactctcatttaaaatcagctggacttgttgtttcaactcgtctggcagttgagcataaagagcttcgcattcttcttgtgttttagctatgattgctgtacgccaataccgggcttttccctgagtcgttcgaatggcatctgctaaccaattcaatttgatatcatctgttgttccttggatgagcaaaggaaggtctccttttcttgctgttgtttctacttgatgttcttttgcaataaaatgattagcaaaatcagtgatttcttttgtggagcgatagcttgtcgttaattggaaacgagtgacttcacggtccacgaaaaggtcttccaatgatccaacgatcgtttcatttccaaagacattttgatttagatctccacagaaagtcaaatttgcttttgggaacaaggcttgcagcaatgccacttgtgatggtgcgaaatcctgcatttcatcaataaagatatagcgagctttgtgtgtaaccgtcactggatatgttcggcgcatcagtaaaaagaatagtacagcatcctcttgacgcaattctctttgacgcaagtgtgtacgaacagttgtcaaatgttcctgccatctggtctcgctgattttatgtcgtgttagaagagaaagtggcacagtttgtagaaagtggagatattgtttcgttatattgacaaattgataattcatgatccctcgatggattcgacggaatcttttacgtacgatttggttggccagttttttacgtaatgaacgctccttttgttctgtatattcaagatttggatctgttgcgtatagttcttggagctgttcttccgctagatctttgacccattgctgacgtgtttcgtctttttgcagaccgcctaattttttcaggagcttcgtttgtaatagagagagtctatgatgtaaaggtaattgttcatttgtttctttataccattggcgaatcgattcctttgataggatcgtacggccatttattttcatatcacggaacaagggaccgtagtttgtgattccttggatatagcgatcaatctgatcgactaaggtcaatccgcttttcatcacttgtatcggatctttttcccctagcaaaaaaccactttcttgttgttgttcatctagtaaagaaaactctggcagcagctgcaccaaataatttttgaatgtctgtgtaggcacgccgctttcacctaatgaaggcaatacagtcgagatgtaatcagaaaataaatggttgggtgaaaatagaagaacgttttcagcctctagccacttgcgattatgatacaacagaaaagcaatacgttgaagcaaagcggatgtctttccacttccggcgattccttcaatcagcattactttacttgttgtgtcccgaatgattgcattttgtgctttttgtatcgtagagacgatgtttttcatatggttgcttgatgattcatccaatatctctagcaaaaagtcatcattgattacttccgacgtatctaccatagataaaatacgtccttcttggattttaaattgtcgtttcaactgcagatcgacatctattctatctgtttcagtttcataaaatgcgggaccaatctcaccttcataataaagattggcaattggtgcgcgccagtcaataacgattgtttcttctgccaaatctcttaaagaagcgatacctagatataatgtttctgtttcacggtcttctttaaagtcgatacgggcaaaataaggactatctttcatgacagacaacgtttgcaggcgtttttgctgtgcttcaagagtatggtatttcaaaagcaattcctgctcatgttggcgatattcaacagcagattcataaaaagcttcattggaaccagctcgaatcttgtgattagctgtgtcttttgtcgaatgattcatttcctgagtcaattcttgttgttttgtatccagcatattttgttcgatctggattagttcgatcgtttcatccacgtgcgtttgttctagttgtttctcattcatcgcatgtttgctccttccgccgtaaataacgaattaaaagtatagcatagtttttcgaaaaaaggtactttttaactgatgaatcgaaaaagtcatccttgctgaatatttttgtttgtagaactgatgaattttggaaacgctgatagtgatagttgttttcaattaagacctattgttttaaaaagtgctagtcaaggactatgcttaagatgaaagaggcagctggaaatttattactaacctctctaagtcacataaaagaggagaaaaaacaatgacacatttcaaaaaatttttacttactttgcttattggtggaatagctttattaagtgaatttgtttttcaccagccggcccttgcatttgcgattgtcgcatttactggagggattctcgccttcttgatgtttttggaaatgatcaagacgttacgttcaggaagatatggcgtagatgtattagcgattaccgcaatccttgcaacattagccgtcaaagaatactgggctagtttgatgatattgatcatgcttacgggcggagatagtctagaggattacgcgaataaacgagcgggtaaagaactccagtctttgttagataacaccccaagaattgcccatcgattcaaagaaggaaatttgcaggatatagtgatcgatgaaataaatattgatgaccagttactagtcaaacctggcgaacttgtacccgcagatggtcgagtgatcaaaggagaatcttcggtcgatgaatcttctttgacaggtgagtcccgcccggaaaccaagaaacctggagatcagattatgtcagggtctttaaatggagacggatcgatccaaatgatcgctgaaaaacgtgccgcagacagccagtatcaaatgattattaaactagtcgaagaatcaaaagaaaagcctgcccgatttgtccgtttagctgatcgttatgcagtccctttcacgttgattgcttatttgatcggtggtatttcttggtggttctcaaaagaccctttacgatttgctgaggtactggtagtggcatcaccttgtccactgattctagctgcgcccattgctttagttgcaggaatgagccgttcaagtaaaaacgggatcgttgtaaaaactggaacaacgattgaaaagctcgcacgtacaaaaacgattgcttttgataaaacaggaacgcttaccaaaggggtattggaagtagaggcgattcagccagtcaatggaataaaaaaagaagagctacttctgtatgcagctagtgcagaacaggaatctagccatatcttagctcgttcgttagtgaacaacgtgaaaaacagccaactgtatcctgttagtcaactgaaagaagtgaccggtcaaggaatccaagcagtagtcaataatcatgaagtaaagattggacgtgcctcttttgtttcagctgaagaaatagaaacgtccaatacagcaatctatgtaacaattgatcgatcttttgcaggaacgatcctattttcggatcagattcgcccagaagcagcaaagacaatcaaggagctaagaaaacttgatgtgaaaaatttgatgatgatcaccggggatggatctgccattgctcaaacgattgcagaaaaagtccaattagattctgtacatgcccgtagcttgcctcaagataaactgaccattttagaaagtatccctaaagatcaaagacctgttgcgatggtaggagacggcgtgaatgacgctccagcacttgctgctgcagatatcggtattgcaatgggggctcatggttctacagctgctagtgaaagtgcagatgcggtcatcttgaaagatgatctcttgcgtgtagcaaaagcagtagtgatttcaagagatacgatgagaatagctaaacagtctgtactgattggcatctttatttgtatttttttgatgttaattgcaagtacgggactaatccccgcattattcggagctgttttgcaagaagtcgtggatacggtctctattttgagtgccttgagagcaaaaaaagatccagccatttttcctgattcagtacccaagacaaacatagtatgatagaatcgagttgaaaaaagaacgatcagaaagaggagagagcattatgccattcgtacatgtcgaattagtagaaggtcgcagtccggaacaattagaaaatatgatgaaagatatcacggaagctgttcataaaaacacgcaggcaccaaaagaacacatccatgtcatcatcaatgagatgaaaaaaggaacatacggtgtaaatggggaatggaaaaaataagtttagtttcccacttgatttttctatttattagtggttaaataaacacataattgattgatgagaaagccaactgaatttgagagtcttcgataagagaggaaaagctaggctgaaacttttccaggagaaaaccaaaggatgaccactttcgaaacccttgttgaagcaagggcggtcggaccgttacaacgcttgaggaacgcatttgcgtttgaacattaggtggaaccacgaacttttcgtcctagtatctcttttcaagagatactaggatttttttgtttttcagcttgatgatctgatcaatcaaaacatttcaaggaggaaactattatgataaaaattacttttccagatagtgcagtcaaagaatttgagtctggaacaacaacattggcaattgctgaaagcatttcaaaaagcttagcaaaaaaagctttagctggtaaagtgaacggcaaactcgttgatttgactcgtccaatcgaggaagatgcaagtattgagatcatcacaccagaccatgaagatgcacttggcttagtccgtcattcagcagctcatttgatggcccaagccatgcgtcgcctctatccaaatatccactttggcgttggaccagctatcgattcagggttttactacgatacagataatggacaaaaccaagtaactgcagaagatttgccagcaattgaagcagaaatgatgaaaatcgtcaaagaaaatctgccaatcgaacgccgtgttctttcaaaacaggaagcattagaaatttttgcaagtgatccgtacaaagtagaactgattagtgaattgccagaagaagaagtgattactgcttatcaacaaggcgaattcatcgatttgtgccgtggaccacatgttccatccactggccgtatacaagtattcaaattattatcagtggcaggtgcttattggcgtggaaactcaaacaatcaaatgatgcaacgtgtatatgggacagccttttttgacaagaaagctttgaaagaatatatccgtctccgtgaagaagcaaaagaaagagaccatcgtaaactaggaaaagaacttgacttgttcatggtttccccagaagtaggttctggtttgccattctggcttccaaaaggggcaacaatccgacgcacgatcgaacgttatatcgtagacaaagaagttagtctaggttaccaacatgtatatacaccaataatgggagatgttgagttgtacaaaacatctggacactgggatcattatcaagaagacatgttcccgccaatggatatgggagatggcgaaatgcttgttcttcgtccaatgaactgccctcatcacatgatggtctacaaaaacacgatccattcttatcgtgaattaccaattcgtatcgctgaattaggaatgatgcatcgctatgaaaaatcaggtgctttgtcaggtttacaacgtgtacgagaaatgacgttgaatgatggtcatacatttgttcgtcctgatcaaatcaaagatgaatttaaacgtacgcttgaattgatggtggcagtatatgctgacttcaatattacagattatcgtttccgcttgagctatcgcgatccaaacaatacagataaatattttgatgatgacgcaatgtgggaaaaagcccaagcaatgctgaaagccgctatggatgaattagaattagattactttgaagcagaaggcgaagcagccttttacggaccaaaactagatgttcaagtcaaaacagctcttggtacagaagaaacattatcaactatacaattagacttcttattgccagagcgctttgatttgacatatgttggagaagacggggaaaatacgcatcgtccagtagttatccaccgcggaatcgtttctacaatggaacgttttgtcgcttatttaacagaagtatacaaaggcgcttttccaacatggttggcacctatacaagcaacaatcatccctgtttctgttgatgcacatggcgattatgcttatgaaatcaaagaacgcttgcaaatgaagggtttgcgtgtagaagttgatgatcgtaatgaaaaaatgggctataagatacgtgcctctcaaacacaaaagatcccttaccaattagttattggagacaaggaattggaagatgcaacagtaaatgtacgtcgttatggaagtaaagaaacagctgtagaagatttgaatatctttattgatgctatggaagcagaagtcaaaaattacagcagagaaaactaataggtaaatttcctgtaaaaaagtagtagatagaaaacaatccgaacaatagataacaggtattcctcaaagacacagatgctcaatagaatctgtgggattgatggaataagatattctgttgggcggattgtttttttgtttttttatccagtatacgaccgtgaataagggtctgatatggtatacttacatagactatcattaaaagggtggaggaacttatgagcgtaattagtcgtattgaaaatatgatggaagattattcctcagcagaaaaaaagttggccaactacattatcggtaatattgagaaggtccctacaatgacagctaatgaattagcagaagcttccgggttgagtgcgccgacagttgtacgtttttccaaaaaaatcggttttcaaagtctgacggacttcaaaatcacgatttcaacagaactacagactggaatcgatgaaggttttagtgatatagaagcaaatgagtccttttactctatcaaaaacaaacttggtaacaatgcacaagtagcgataaaagaaacagtagatattctagaagaagaaacgatccaaaaagtcgtagagtgtttggaatcggcagagactgtttttttatatggggttggcgcctcttctttagtagtagaagatattctgcaaaaatggtctcgtgtcggtaagccaatcatttttgaaaaagatatccacgttttgctcccgcaacttgtcagcaatgagaaaaagaaagtgctttggcttgtttcaaactcaggtagaagtgcagatgtagtcgcattagccgagctggcgaaaagcatgaatatcgaaatcattgcgttgacgcaatttggaaataacccgcttagcaagatagccgatgtactcgtacaaacatctagaccaaaagaaatcacgaatcgaagtgcggcaactaattcacttttggcccaatttgctacgatcgatatcattttttatttctatatggctaaaaacgaaaagcttagcgaaaaagtgaaaaaaacacgagaagcaatccaagaatattttatggattcgaaataaaaaccttactattttttatataagttttttagaataacaaaacgtagttttccacaaataaatgacccaccaaagtgtttcacgacttaagaaaacacaattttcaaaaataagtttattttttaatgaaaaaaatagttgaatatgtaactttaagtgattactgtgaaacaaaaagttgattttatcttgaaattaggtaaagaatttcttgctccgcccattttttcttttttattaagaagtttttgggtacaatgaagcatgaatgtaaataggcggaaggataggaaatgatgaaagattttatgaaaaaaatattaaatacttcttggttagaaaaaataagaaaaggtgcacaagaacctaagaacaaaacgtttcgccggtcccatgttccttttcgcttaaattttctttttttcattatatttacgttatttgttgcgttgattgctagattgggttatttgcagatcgtgaacggcgaagagatggaggcgcgagtgaagtctacttctacgattacggtccaagaaagtactcctcgcggaatgatctacgactccacaggaaaagctttagtcacgaataaagcgaatcaggccatcacatatacgagaggaacacaagttacggctaaagatttgcttgaaatcgcaacgaagttgaactcgctgatcgatgttccggtagatgaaaatctgacagatagagataaaaaagatttttggctggctgaccccaaacatttgaaagaagccacaaaaagactttcggcaaaagaaaagcaattagggaacagcgaacaatatagtgcgatggtcaataaagtcacagctgatgagattaatttaaacgaggagcaattaaaaattgctaccatctttaaacggatgaatagtgcatatgaattaaacactgtctatatcaaaaactctggtgttactgatcaagagttagctgttgtggcagaacgcgcttctgaacttccaggagtttcgactggcacagactggacacgagaatataatgcagcaagttcactgaaaagtattcttggcagtgtgacaactgaaaagcaaggacttccagcagatgaagcagagaaatacctagcaaaaggttattctcggaatgaccgtgtaggacaaagttatttggaaaaacaatatgaagatgtcctgcaaggaaccaaaacccaatatgaagtttcccttgataatgaaggaaatgtttcgaatcaaaaagaaatcttctctggggaaaaaggttctaatttaatgttatctatgaatgcagaattccaatcaaaagtagaagaaattttgaaaaggaattatcaaacattgatcaacaacggcaaagcacagtattcgcctggtgcttatgcagtggctatgaatcctcagacaggagaagtgctagcaatgactggtttcagtcatgaacaaggttccaaagaaatcaccgagaatgctttaggcacgattactagcgcctttgctccagggtctgtagtcaaggctggtactttgacagcaggctgggcaagtaacgcgatcagcggaaatcaagttttgattgatgagccgattcgtctgcaaggtgcttcagaaaaaagctctgtctttaatcgaagcggacaagttgctcttgatgcagtcaaagcattggaattgtcttctaatacgtatatgatcaaagtggcgttaaagatgttaggactagactatacacctggaatgggactacctagtttagatgaagaagctaaagcttatcagcaattgagagactctttcaaagagtttggtcttggtacaacgactggaatcgatttgccgaatgaatctcctgggatctcacgttctgttgattatatgaagaagttcaatgcggataatggcaaagaatggtatactccaggtaactttaccgatttggcatttggacagtttgacacatatacaccaatccaattagctcaatatgcttcaacagtcgctaatggcgggaaacgagtacagccgcacctagtcaaagcgatctatggcaatgacgaaaatggaaacttgggtgaagtgaagaaagaaattggcacaacagtagaaaatacggtcaatatttctgcagaaaatatggcgatcctccgtgaaggattccaccaagttgtccatggtaccgatccttacacaacagccaaaccattagccagtgcgaaaatggacctttccgcaaaaacagggactgcagaaacggttgcggaaggtcatccagatattacgacagtcaatagtaatatcgtggcatacggaccaacagacaatccggaaattgccatcagtgttgtcttgccgaacttattagacgaacaagaccacatgaacttgacgattgctaaagaaataatggacgcgtattatgatatgttcatggcaaaataaaaaagaggtcgtgaaaaagccgcttagtttcgagtatgaagaaaaattttgtgaaaatagcttctcacatttttgcttaaatttgacttcataccgagaaactggcttttgaacaccgtttaaggaagaggttgtgaaatcagcgccctgacctgagtattagagaaacaaaacggaaaaatagcttctcatattttgccgtttttgagctaataccgaaggacagctgattgaacgccgtttatcaagaggtcgtgggcctgccattcagctccgagtcacaaggaacaagttcaaaaaaacagcttctcatgttttatgaatattgtgacttgtgattgaggagttggcaggagaacaccgtttactcggcaaaaaaggttgtgacaaaaattgtcacaacctcttttttgtggaatctaattctctattatagtttaagtagtttttccagataaacagctaaaccgtcttcctgattgctcaaaggagtgacatcatttgcaatgcctttgagttgatcagtaccgttagtcatagctactccccaacctgcataatccaacaattccaaatcattatgctcgtcaccaaaggcaatgacgtctttttgatcgatagacaggtagttagcaatctcttgcacgccttttgctttttggattccttttgaaacaatctctaagatggcagtaggtccaccccatgtccgaacatcgacataactgccaaattgacgtgttaattcagcagatacagctcctgcaaaacgtttgtctgttcggacaagcaaagacgtaggatttgtcgtcaaatttttaggagaaagcaaattcttctctcctggacgagaagaagcaaaaattttttcatcaaagaaatcaaaactgtcaataaaaaaagtatcacgattttcagcagcgataaaatctaaatttagctgctttttttgcgataagatttcaaaagcgatttcacgattgatcaacgtttctctttcaccatcccagtgctgattagggatgtgtactaatgcgccgttaaaattaaccatcggtgttgttaattctaattgttggtaaaactgatggctcattcggaatgggcgtcctgtagcaatactgacatgatgaccggcattgattgcttttttcagagtctcttttgttttagatgtaatcatcgaatcttgattgagggtagttccgtccagatcgatggcaattaattttttattcaataagggtccttccttcctcaactagcatttgttttagtctagcatattttaggtaattaacaagagcaatcagttattcctaacaaaaaatacagttatggctatgtaaataaatgaatacgagctaaacacgaacattaagtattgttttcggtttttttgttaaaaaaacgttgaaaaacgaatgaaacgtctatataatttgaaattgttcgatggatttgccatattttgcatatttattattattatagttttccatcagaaaaaaattcagggagtggaactttttatggaaaagtttttcggtttaaagaaaaacaatacaaatgtatcaactgaaataatggcgggagtaacgacattctttgccatgagttatatcttattcgtaaatccgacgattttatcagcatcaggtatgccgttccaagcagtatttctagccacaatcattgcatcaatcattggtacgctagtcatgggattgttcgcgaatgtcccatatgctcaggcacctggtatgggattgaacgcatttttcacttttacggtcgttttcgggcttggctattcttggcaacaagccctggcaatggtttttatttgcggattaatcaacatttttattactgttacaaatatccgaaagatgatcattcgggcgattcctgaaagtcttcaacatgcgattggtggcggaatcggtattttcgttgcgtatgtcgggatcaaaaatgcaggattcttatctttttcagcagaccaatctgctatttcgagttctgtcgttgaaggtggaaaagcaacaaatgttacgataaatggcggaatcgttcccgcgttagccaattttgacaacgcacctatcttgttagccgtgattggtttggtactgacagccattttagttgtaaaaaacgtccgtggtgctattcttatcggtatcgtagcgaccacagtccttgggatttttatgggtgttgttgatttaagttccattgattggcaaacgaattcgttaggcaattcatttaaagaattaggaacaacgttcggtgcagcatttggttctgaaggaatgcaatcattattcagtgattcttccaagatccctcaagtattgatgacaatcatcgcattcagtttatctgatacattcgatacgatcggaacatttatcggtacaggacgccgcacaggtattttctcaaaagaggacgagatcgcattggaagatggtcgcgggttcaaaacaaaaatggataaagcgctatttgccgatgcaatcgctacttccgtaggtgctatctttggtacatcgaatacaacaacttatgtcgaatctgcagctgggatcggggccggtggacgtactggtttgacttcagtagtagtggcagtgctattcgcattaagtagtttgttctccccgctgatcgctatcgtaccaaatcaagcaactgcgccagcactgattttggtcggggtaatgatgatggcttcttttgcagacatcaaatggctagatatggaagaagctttaccagccttctttgcatcgatctttatgggattgtgctatagcatttcttatgggattgcagcaggatttattttctatacaattgtcaaagtaatcaaaggaaaattcaatgaagtttctgttgctttgtggattgttgatattttattcatcatcaacttcatcattctagcaacgatttaaataaagagaagggattggaacagcatttgttctggtctctttttgttttacataaaaagaacgttacatataaaatgatctttgtgggatttttctctttttactagcgagatcgttgcttgtttattcgaaaataggtatgataaaagagacgaaagagggatgatagatggagattaattggagaaaaaatttagtgattgcgtggattggctgttttttcactggtgcaagtattagtttagttatgccattcataccagtttatgttgagcaactaggaacaccaaaagatcaaatcgaattgttttcgggactagcaatctctgttactgcttttgcatctgccgtggttgcaccaatctggggaaatctagctgatcgaaaaggtcgaaaactcatgatgatccgtgcagcagctgggatgacgttgacgatgggttctttagcttttgtgccgaacgcgtattggcttttgatcatgcgtttttggaacgggattttgtctgggtatattccaaatgcaacagcaatgattgcttcacaagcgcctagagaaaagagcggatgggcgttaggaacattatccaccggagcgattgctgggaatctgatcggaccttcaatgggcggtgcattggctgagtggtttggtatggaaaatgtattcttgatcacaggggctttgttgatgatcacaacggtgctgaccatcttcttagtcaaagaagatttccatccaatcgagaaaaaagatctgataagcaccaaagaaattttttcaaaaatggatcatctctctattttgattggtctcttcatcacgaccttgattttacagatagggatcactacgatcagccctattttgaccttatatattcgtgagttaagcggaagtacagaaaatatcctgtttgtcagcggcttgattgtttcgatagctggtgtttctgcagtcttttcttcaccaaaactaggaaaactaggggataagattgggaatcaaaaagttttaattggcggactcatcttatcattttgctgttatttgcccatggcgtttgtcacgacaccactccaattaggtatacttcgttttattttaggcttttcaactggtgctttgatgccttctgtcaatacactgatcagtaagatcacgccacaagaaggggttagccgaatctatagctataatcagatgttcagtaactttggacaggttctaggacccatgctggggtcgacagttgcgcatgcttataattacagtgctgtttttattgtgacaagtttattcgtcctgtcaaatattcttctttctctattcaattttcgtaaagttcttcgcagtagattataatagtggtgaaaattggaaataaaaaagagcttgagatatctcaagctcttggctggttttttacgaatgggcagaggtttcttttcttggcgcaactgcaccaatcaaaaggataatgacacccgcaattaatgaaatgattgttgtcaaagtaaaatcatatgttccgcttgttaatgcagcaccaatataaccgactacttgacctagaacgacagcccagaataatgtaacgatatatcgcataaagaacacctcttttctatcttaattttaccagattttctttgaatgtaaagaaacgagactaaatctcaataaaattcgagttcttgtgaaagaactcattcctacagactagaagcaaatgaagtagaacaatcaacttcagcacttgttatttaatgaaagtaaaaggatcagaccttttaacgctagtgaattttaacgaaaaaaaaggcggaatgcaagatgtttttcccacaactttatacaattacttcttattctcttttacaaagtacgatccgtattcgagaatatgtacaagaagcaaaaaaacgaggctacacttcattagccataacggataaagatgtcttatacggtgcacctgaattctatcgtatttgtgtagaagaaggaatacagccaatcattggattacatcttagttatacttatgaagaaaaaaattatggtttgcttgcgtacgcaaaagatgagacaggttatcagcagctgatgaaactttccagtcgaaaaatgatccaagaaaaaatggcacttgatgatatgatagaaaccgaccatctagtgtttgtcgttccggcaaatcattctgtttctgaggctttcaataaagaggaacattttttcagtcattggcagtttttgcttgaaaatgttttcgctaaagatttttatatcggattgtcagaaaatacgcctgatcaattgcctgaatggtatcagtatgtgacaaaagaaaattatccgctttgtgcattgcatccaatcgctagtttacagcaagaagacctttttgcgcttgaagtgatgaagcatatcaaagagggaagtcagatgcctttagaaagtttatctgcacctttaccatcagcaaatggttacctgctttcagaacaagaaatgatcaaacgattcgaagaagcaggtctttcacaagctgtaataggtgctcagcgcttagccgaatcgatttcatttgaatttcagtttcatcagaaattactcccacactatcctgtccctcaaggaaaacaagctggagaatatttaagagagctatgctactcgcaagtagaacatcggatcgttgattatacaaaggagtaccgagaacgtttggactatgagttatctgtcatccatcaaatgggattcgatgattatttcctgatcgtatgggatgtaatggcttttgctcatagaaataaaatcgttaccggtgcaggccgtggttctgctgctggttcattagtagcctatgtgttagaaatcacagatgtggatccattagagtatgacttgctattcgaacgatttttaaatcctgaacgttttacgatgccggatattgatttggatattcctgacaaccgacgtgaggaagtattgaattatgttcgagaaaagtatggacaatatcacatggcgcaaatcgcgacatttggtacaatggctgcaaaaatggttcttagagatgccgctagagtgtttggtctgtcacaaagtgaagcaaaccgctggtcaaaagcaataccaaaccagctgaaaatcacattgacccaagcctacaaaacatcgcgtcaactagtagaattagttcaggcaagcgaaaaaaaccagcttttattcaaaaccgcagtgattttagaaggattgccaagacacgtttcgactcacgcagcaggggtagttatcagcgataagaatctacttgaattagtaccgctccaacgcggttctgatgaagcttttctgacccagtatacgatgaatgaggtagaagccatcggtcttttgaaaatggactttctaggactacgcaatttatcgattattgattttactttaaaggctgttaagcgagtagaagggcaggaaatccgattaaaagagattccattaaatgatgcaaaaacgctactcttgtttcaacgaggcgaaacttcaggagtgtttcaatttgaatctgctggtattcgaaacgttttacgaagattaggaccagaaaacatcgaagatattgccgcagtcaatgcgttgtatcgtccaggtcctatgcaaaatatcgataccttcattgccagaaaaaaaggaaaagaagccattcgctaccccgatgattccctgatccagattttgaaaaacacatacggggtgattgtctatcaggaacaaatcatgcaaatcgcctcgactatggctggatttacattaggacagtcagatattttgaggcgggcagttagtaaaaagaaaaaagacgtattagatgaagaaaagtcgcattttgtatcaggagcattacaacaaggatattcggaaaaaacagcagtgactgtatatgaatatattgaaaaatttgcaaactatggattcaatcggtcgcatgcatttgcttattccttcgtgggattccaaatggcgtatctaaaagcccatcatccaggtgctttctttaccagcctgatgaattctgttcggcataacacatcaaaattgaaagaatatattgcagaagcacgtaaaaataaactcaaactttcctcgccgtccattaatcaaagtaattccagttttgagttggtcaataaggaagaaatcagattcggactgacagcgataaaaggtattcggcgtgattttgtagaagatatattaaacgaaagaaaacaaaatggcccgttccagtcagtggatcaattcctcatacggatcgataagcggtggctgaaattagagttgctgcaatcactgacagcagtaggcgtttttgatgaattatctcctaacaggaaacaattgatgcttgatctagaaggaaaaatccaaaatatcgtttacagtggtggcagtctagatttgctaggaatcatggcattaaaagaagaagaagtcgctgactatacactagaagaacgactgaagctggaagaggaatacttaggtgtttatttgtcagggcatcctgcagaagggtttgaccggcttcgtttagctaaacaggttcagctgattacagatatcgttcctaatcaaccagtcaatttactattgatgataaaggaagttagagagattcggacaaaaaaaggcgaactgatggccttcgtggaaggaaccgatagtagcggagaaatttctgtcacggtttttccaactctttatcgtaaatatcgtaatttgtttgccgttgatcgagtgatctttgttcaagggcggagcgaaatcagcaaatataatcaggaactgcaactaattggagaaagctttgctgatcctaaccagttagaagcccagtatccttcacaaacgtgctatttgcgtattacagaagaacgggaagaccctgagataatgaaacaattacaagggatttttcagaaacacccaggatatattccagtaattatgtaccacgaaaaaacacaacgaaaagttgttctgtccgatgcttattgggtggatgacagcaagagtataaaggggcaacttgtttctctacttggcgaagataatgtggttttcaaataacttacggtaaaaaatactacttgctttcattttttttcatttttttatccgtaaatcaagacaagcgagaaaaataatgttagaatgttagtcgtggttaacgcaaaaatggttgtaaacctaagttatacttaggataaagtattttaatgaggtgaatgtttattatgaaacgcatcggaattttgaccagtggcggagacgcacctggaatgaatgcagctgttcgtgccgttgttcgtaaaggtatttacgaaggactggaagtatacgggatcaattatgggtttgccggtttagttgctggagatattcgtcgtcttgatgtggcagatgtaggtgacaagatccaacgtggtggtacattcttgtattctgcacgttatccagaatttgcaactgaagaaggtcaattaaaaggaatcgaacaattgaaaaaattcgggatcgaaggtctagtggttatcgggggagacggttcttatcatggcgcaatggctttgacaaaacgtggattcccagcagtaggtattcctggaacaatcgataatgatattcctggtactgacttcacgatcggttttgatacagcaatcaatacagtgctagaatcaattgaccgtattcgtgacacagcgacttctcatgttcgtacattcgttatcgaagtaatgggacgcaatgcaggtgacatcgctttatggtcaggtgtagctggcggagcagatgaaatcatcatcccagaacatgattttgatatggcttcagttgctaaaaaaatccaagaaggccgtgatcgtgggaagaaacattgcttgatcatcttggctgaaggtgtaatgggcggaaatgaattcgctgaaaaactttcagaatttggcgactatcatacacgtgtatctatcttgggacacgttgtccgtggtggagcaccaagcgcacgcgaccgcgtcttagcaagtaaattcggtgcttacgctgtcgaattgcttcaagaaggaaaaggtggattatgtgtcggtatccatgacaacgaaatcgttgcagctgacatcattgatacactagaaaacaacaagcataaaccagacttatcattatatgatctaaataattcactttcattttaagagtgaaagaaaccaagctatttaagctgtgtacagctttaaataaacaaaattgaatgggagagttttttaaatgaaaaaaaccaaaatcgttagtacattaggaccagcaagtaactcagtagaaattatttctcaattgattgaatctggggcaaatgtcttccgctttaacttttctcatggtgaccatgaagaacaattatcacgtatgactatggtccgtgaagcagttaaaaagacaggaaaagatgtcggtattcttttagatacaaaaggagctgaaatccgtacaactgttcaaggcacaacagaagctgattttggtcgtgcaggatacatcaaatttgaagtaggagatcaaacacgcatctctatggatcctgaacatgtaggttcaaaagaaaaaatcgcggttacttacccaggattatttgacgatgttcacgtaggcggacacgttttattcgatgatggcttgatcgacatggaaatcattgaaaaagacgaagcaaaccgtgaattagtcgtagaagttaaaaatgcaggtatgctaggatcacgtaaaggggtaaatgcaccaggcgtttctatcagtttgccaggtattactccaaaagatgcggacgatattcgttttggtttagacaacgatatcgactttatcgctgcaagttttgtacgtaaagcacaagacgttctagatattcgcgaaattttagaagaaaaagacatgactcatgttcaaatcttccctaaaatcgaatctcaagaaggtatcgacaacattgacgaaatcatcaaagtttctgacggtgttatgattgcccgtggagatatgggtgtggaaatcccagctgaactagtaccaatggttcaaaaacgtatcatcaaaaaatgtaacgctgctggtatcccagttatcactgctacacaaatgttagaatcaatgcaagaaaacccacgtccaacacgtgcggaagcttctgacgttgccaatgctgtatttgacggaacagatgcaacaatgttatctggtgaatctgcaaacggagactacccagttgaagctgtttcaacaatggcacgtatcgaccaagaagctgaaaatgcattatcagaattaggtacattccaattgaacgaattcgataaaacagatgtaactgaaacaatcggtttatctgtagctcgtgctgcaaaaaatctaggcgtcaaaacaatcgttgctgcaactgaatcaggctacactgcaaaaatgatttcaaaatatcgcccagatgcagatatcttggctgttacttttgacgaacgcacaaaacgcggtttgatgttaaactggggtgtttacccaacagttgctgaaaaaccatcaacaactgatgaaatgtttgaactagcagctaaaaaagctgttgaattaggtttcgcatcagaaggcgatttaatcttgatcactgctggtgtaccagttggcgaacgcggaacaactaacgtgatgaaaattcaaatgattggttctaaattattagaagctcaaggcattggacaaaaatctgtcgttgcaaatgcagttattgcttcatctgctgaagaagctgtaaaaaaagcaaaagacggaatggttctagttgtaccatcaactgacaaagaatacatgcctgcaatcgaaaaagcagctgctgttatcgttgaagaaggcggattgacttctcacgctgcagttgtaggaattgcacaagatattcctgtaatcgttggtgctaaaggcgcaacaacaacaattactgatggcgaattgattactgttgattcacgtcgcggcatcgtttaccgtggcgaaacaacagctatctaatttagcttaatacaaaataaaaacagctcttcatttacgaagagctgtttttttgtgctgtaacgaattcatggatgacttggactacttgttcttgaagcggtgtgacaagctgttgtgttcgttttgccaatgaaatcaagaagcgaggctgaacttcatctgaaagtggcaggcaaactaaatgatcttcaggatggacagcaatctctgccaaaaaaccgataccaacattttcacggatcatactctttaaaatcgtcaaatcattgctttgataaacaacttttggttgagtatgtgtttgtttagaaagtttagtgaatgctgctgggtggacataatgttcgttcaataacacaaactgttcatctgatatatctttgaaagagactgccttctgctgggccagagggtgagtaggcggaacgacgatcatgaaacgtttatccaaaagtaattctgtttctaaatattgatctacgattggctgtgttgagcctaatacggctaaatcgatcctcccttgacgaatcattccatataagtcccgagagcctccatcggtgatttcaatctgattcatcaattcatgcttgataaagtaacctgacagttttggaaagtactcattgccgataataggcggcatgccaaaacgcagctttttcttttgtaactgagtgatttcagcccttgcagtagaaatctcttggagaatagcttgtgcatggagaaacagctgctttccagaaggtgtgacgattaattcgtgatgcgaacgatctcttgtaataagtatggcgtcaaactctttttcaagacgttgtaatgcatatgtaatagtaggttggctcacacggaaataattagccactttcgtaaagtttttttgtttgacgatttggacatagtattcaatatctttcgtgttcataaagatcatctgctcctttgatagaataatgattattgtaaatgattctaaagatgatagcaaacagaggctttctgttaaagatatttctgtttttttatgaactgcaaggtgtcaagaaaatttcattgacaacatggtttttgccctgtataattgcttttgttgcttaggagtgatgaaaaatgaaatggtctttattggaattgagaaaataccaggagacaccgttaacttttcatgagacgctcgacttgaaagccgctctcatgaagcgagacaatttaatacttgatgttgcgccagtggaagtcgaaggtttggtctcagttgataagaaaggctatatcgttcattacactgtgcagacgactttgacagttccttcaacacgttcgctagaacctgttgaactgccgatggatttttctgtagacgaagtattcatgacagaagaacaattccaaagcagagatgagcaaatgtctgcagatgagattttgctgattgaaggtccgttattgaatttagcagagtcaattgaagacaacatcttattggcgattccgatgcgggtattgacaaaagaagaggaagcagcgacagaacttccaaaaggcaatgattgggaagttgtttccgaagaagaataccaacgcagaaaaatggaagaagccgagaataaaattgatcctcgtcttgcaaaactatctgaactttttgattctgaatcaaaaaacgacgataacaagtaagattggaatatattgtatctattataggtgcaagactttacaaggaggtgtagcaaaatggcagtaccagctagaagaacatcaaaagctaaaaaagcaaaacgtcgtacacactacaagttgacaatcaaaggattaaacgaatgtccaaactgtggtgaaatgaaaaaaagccatcacgtatgtgcaaattgtggttactatgatggtaaggacgtaatgtcaaaagaagcttaatacattttaattagaaaatgtaaaacctcaaggctaaccatggagccttgaggtttatttttttataagcggtaaataaaaaatatgttgttctttagtttgcattgtagccgtgttaagctataatgtaagagattagggagaaatcccgtatgtaggaggagtttatatgtcaaaacaacaaatcggcgttgtcggtatggccgttatgggtaaaaatctagccttgaatatagaaagccgcggctattcagtggctttattcaaccgtacaggggctaaaacaaccgctgtagtagaagaacacccagataaaaatttcaaagcaacgtacacaatcgaagaatttgtagaatcaatcgaaaaaccacgtcggattcttctgatggtcaaagcaggaccggcaacagatgcaacaatccaagagttgcttcctcaccttgataaaggcgatattctgattgacggaggaaatacattctttaaagatacgatgcgtcgtaatgaagaattagccaactctggtattaactttatcggtacaggcgtttccggcggtgaagaaggagctttaaaaggaccttcaatcatgcctggtggacaaaaagaagcgtatgagctagttgcaccaatcttagagcaaatttctgcaaaagcagaagacggagcaccatgtgttacctatattggcccaaatggagccggacactatgtgaaaatggtacacaacggtattgagtatggagatatgcaactgattgctgaatcttatgacttgatgaagaatattttagacctttcagtagaagaaatggctgatatctttaaagaatggaatcaaggtgaattagacagctacctgatcgaaatcacagctgacatcctgactcgaaaagacgatgaaggcacaggtaaaccagtcgtagatgtgatccttgatgcagctggaaataaaggaacaggtaaatggacaagccaaagtgcgcttgacttaggcgtgccacttccattgattactgaatctgtatttgcccgttacatttctgcttacaaagaagaacgcgtacaagcaagtaaaattttgtctcgtacgaacgattttgagttcacaggagacaaaaaagaattggtcgaaaaaatccgagaagcgttgtatttcagtaaaatcatgagttatgcccaaggatttgctcaattacgtgtcgcttcaaaagaatttgattgggatttgccatttggcgaaatcgcaaaaatctggcgtgctggatgtatcatccgagctcgattcttgcaaaaaatcacggatgcttatgacaaaaatcctgagatcgaaaatttattgctagatgattatttcgttgaaatcacgaaaaaatatcagcaatcagtccgagacgtcgttgccttggctgtccaagctggcgtacctgtaccaactttctcatcagccatcgcttacttcgattcatacagagcagaacgtctgcctgcaaatataatccaagcccagcgcgattactttggcgcacacacatatgaacgtgtcgacaaagaaggaatcttccattactcatggtaccatgaagaataatagtctttcggctgttaggaaatgagaaaataaaaagaggacgaaagagctgaagtcgattgttatgagtagacttcagctcttttttaaaactgctattcatgataaaatgactatagatttttaagcagattatcggtataatgatagagtttttaaaaagccagtagatagaaaggataaaataataaatgagtaatattctaatcattgaagatgaaaagaacttagctcgatttgtcgagctagagttgaagcatgaagggtataacgcagaagtccattacaacggtcgtactggtttagatgcggcattaaataatgagtgggatgccatattgttggacctgatgcttccagaattgaacggtttagaagtctgcagacgcgtacgccaagtcaaaaatacaccaatcattatgatgactgcaagagattctgtaattgatcgtgtatcgggacttgaccatggagcagatgactacatcgtcaaaccatttgctatcgaagaactattagcgcgtcttcgagcattgttgcgtcgaatcgatattgaaggtgacaaaaatgtggcaaaacaaaccactattacttatcgtgatttgactatcgaaaaagaaaaccgtgtcgtacgtcgcggaaacgaagtaattgaactaacaaaaagagaatacgaattgctacttactttaatggaaaacgtgaacgtggtattagcacgtgatgttttactaaataaagtgtggggatacgaaacggaagttgaaacaaacgtagtggatgtatatattcgttatcttcgcaataaaattgacgttccaggggaggaaagctatatccaaactgtccgcggaacaggttatgtgatgcgctcgtgataaagccgaaaaaatcggaaaaaagagaactgaaagggccctccttgacaatcaagtgggcctttgcgagttctttcttcatattcgtcgtgtttacaatttttgcggtcattacctataaatcatctatcaatctgattgttgcaaaagaaagaaacaatgtagaacgtacgatttcagaagtagcctctcgtttggctaactcggatgaagaactgacattagtgaatacgtatcgtaatctgacaaaagcgacaaatgacggagatgaggtcatagatcatacttcactggtcgaaggaaacttaatgaagattgattcctttatagctgagctagggcagccttcgatgggtctttatgtgtatgatttagatgagaatttgattttcaaaactcacgaaaacagtcgaaacttgatccaaacaacacgtaaagtgccaacgattgttacactagaagggaaaactggctttttatctatacagcctatatattctaaaggaacaagagaaaagattggttatgcgcaaagcttctatgaattatcttctttctatgatatccgaaataagctattattgactcttattgttttagaagtcgtttctttgattttaagtagtattttaggtttctttttatcttcttacttcttgaaaccactcaaggtactcagagatacaatggatactatacgtaaagatccgcaatcagatatccacatgcctgaaatcgacacgaatgatgaattggcagatttagctgaaatattcaatgagatgcttgaccgcatgcgtttgtatatcgaacaacaagagcagttcgtggaagacgtctctcatgagttaagaactcctgtagcaatcattgaagggcatcttagtctgctaaatcgttgggggaaagatgatcctgaaatattggaagaatcattaagcgccagcatgcaagaaatcagccgcatgaaaagcttagttcaagagatgctagacttatctagagcagaacaagtagatgtccattatgcaaatgaaacaactaaaggaaaagaagtcacctatcaagtttataataatttcaagatattatacccagactatgtgattactttagatgatgatttgacaaaagaagtgaccctgcaaatttatcgtaatcactttgagcaattaatcattatcatattggataacgcagtaaagtattcaactacacgaaaagaagtccatatctctatttcttctactctgaatgaatttgagattgctatacaggactttggtgaaggaatacccaaagaagaccttaataagatcttcaatcgtttttatcgtgtggataaagcgagggctagaacgaagggcggaaatggtctgggattgtctatcgcaaaacaattggttgaaaactacaaaggtcgtatcttagcagaaagcgtagttgggcaagggactatctttagaatttttattcctatcgcaaaaacagaagacaagtaaagcatgtgctttgcttgtttttttatattatccattaagaaagaggaagccaaatacaagcagataagaaatttaggatggtcattataaagaaatttagcgaacaataaaatagaataacattcgttgataaattgtaaatagcttttatgtgaacaaaaaacaataaaaacactttaatattcgtctttaaaaataataaagaaaaatagggaattttctattgcaattttataaagagattgctatattattatttgttctaaatgattcctttaaggtgtcgctaaaaattataaaaaatagtgttgacgcacttttgatatcgtgttataataacgaagtcgcttagatgagaaagcttataaagcttgattttatcgaaaaaaacttcaaaaaagttattgacaaataacgatcgaaatgatacgataatcaagtcgctgctaatgagcgataaagacatttagaaaaaaaacaaagaagttgttgacgttctcttctgaatctgataagattaaagagttgttgaaacaaaaagattagacctttgaaaactgaacaaagtaagacaaaccaaatgtgtagggcgtcttgattcgattcaagacaacaaacatttttaacaagcaagcaatatgctagcaaacaaattgagcttaacaatttttgagctatgtacaagaagcattttattctagcttaatttgacaaatcataacttaaaacggcagaccatgctcgtttcttttttttatctatgataaaatacaagcatatccatgaaaaaagattaataaacaaggtggaaacagatgaaaaaaatcgtaatcaaaggaaaccaacctttagctggtgaagtaacgatcagcggtgcaaaaaatagtgcagtcgcattgattccagctgcaatcttagctgattccccagtgattttggaaggtgtgccggacatacaagatgttcattcattaattgaaattttagagatcatgggcgcaacggtccatttttccaacaacatattagaaattgacccgcgggaaatcgtatcggttccgatgccgcacggaaaaatcaatagtttgcgtgcgtcttattattttatgggaacactgcttggtaaatttggcgaagcggtagtaggcctgcctggaggctgttatttaggtcctagaccgattgatttacacgtcaaaggatttgaagctctaggtgctgaagtgacaaatgaacatggtgccatgtatttacggacaaaaaatgaagggttgcatggcaatcggatttttatggacgtggtttcagtcggagctacaatcaatgtgatgttagctgctgtaaaagcaaagggacagacagtaattgaaaacgctgcacgagaaccggaaatcatcgacgtggcaactttactgaataatatgggggcaaaagttcgaggagcgggtacagatgtgatccgtatcgaaggagtcgaagcattacatggctgtcgtcatttcatgattcctgaccgtatcgaagcaggaacctatctggcattagcagctgcagcaggaaaaggtatcaaagtgaaaaatgtaatttttgaacatttggaaagttttatagcaaaattgcaggaaattggcgtccatatgaaaatcagcgaagatgaaatcgaagtttacccctcaaaagaattaaaagccgcaaatatcatgacctatccttatccaggatttgccacagatctgcagcaaccactcactgcgttgctattgatgaccgcaggcacttcagaaatcattgatacgatctatgcgaaacgggtgaatcacgtgcctgaattagctcgaatgggcgctgatattaccgtggaaggaaatatgatcatcgtgaatggtccaaataaacttcacgggacagaagtcgtggcttccgatcttcgggcaggtgcttgtttagtgattgccggactattagcagaaggaacaacgacgatttataacgtagattatatcttacgcggttatgatcatattatcgagaaactaacagccttaggggcatcaatcgaaatgatagaggaagtgggagctgaatgagcgattatttgacaatggcagaactagagaacaaaacgttaaaagaagtttatagttatgccaaagaatttaaaattccttattacagtaagatgaacaaaaaggaattatctctagctgtgattcgtgcacaagctgagaaacaaggattttattatatggaagggatattagatatcgttggtcaagatggttacggttttttacggccaattaactatggaccaagtgcagaagatatctatatttctgcctcacaaatcagacgattcagtttgagaaatggggacaaagtggcaggaaaagcccgtccacctaaagaatcggaacgttattatggtttgatgcacgtggaaagcgttaatggaaaagatccggaagaagcaaaagaacgtccgcattttccagccttaacacctctttatccgcaaagacagcttcaactggaaacaacaccgcaaagactatctacccgaatgatcgatatcttctctccaatcggttttggtcagcgtggattgatcgtcgcaccaccaaaagcagggaaaacttctgtattaaaagaaatcgcaaatggtatcaccgaaaactatccggaagtagaattgatcgttctactgattgatgaacgtccggaagaagtaacggatttagaacgaagcgtgaaaggcgacgtggtatcttctacatttgatctgcagccgcaaaaccatactcgagtttctgaattagtattggaacgcgcaatgcgtttagtcgaagataaacgagatgtcgttatcttgatggatagtattactagacttgctcgggcctataacttagtcgttccaccaagcggacgtacattgagtggcgggattgacccagccgcattgtataaacctaagaagtttttcggggcggcaagaaacatcgaagaaggtggcagtttgacgattttagcgaccgctttagtcgatacaggaagccgcatggatgacgtgatctatgaagaattcaaaggaactggaaatctagaattacaactttcacgcgagttatccgaacgtcggatcttcccagccatcgatatcaaaaaatcaggtacccgaaaagaagaattattgatgccaagtgaagaactagaagaaatttggaaacttcgaaaaaatatgactggagattcattagaatatacggaacaactgatccgctttttgcgtaaaacaaaaaacaatcagcaatttttcaaagaatttcaagatgtctcctttggtaaaaaaaatccgaccagaaatctgaaaagataattgcaaccttgactgaaacatgttaagatgttaatgttgtaaagcgacaaatcaactctggttcagcaaatggagcagggcaaaggagcgaaaaaatcatgaaagaaaacatccatccagattaccacccagtagtattcatggattcaacaactggtttcaaattcttgtcaggttcaacaaaaacttcacaagaaacagttgaatgggaagacggtaatacatacccagtcatccgtgtcgaagtaacttctgactcacatccattctacactggacgtcaaaaattcacacaagcagacggacgtgtggaccgtttcaacaaaaaatacggtctcaaagacgcaaacgctgcggaataataaaaacgctgataactcaacgtttagcagactatccgatagggatagtctgtttttttcgtttttgaccataatgaatagatggatatcgttactcaaaaatgggtgggatacagtaaattttttcgaattttattaaatcaaatttaaattcattgattaaactatccatctctaataattctagtccttgtaaaattttcattattcgttttcgtcctttgatgctatctccttctatatgacagattaatgccttataaaattgaatggatatctgagtatcttttgcaaacaataatctatgatgagtagcttcaaatttttgtaagtattgtttagaaaagtgaatatttttgcgttctaacattaaaaggaaagcattattataaagactggataatatcggatgaaatatttcaaaatcgttgtatttttcaattttgcgttcgatttctgtaagcctttgggaaatatagtttgtatcaaaaagaaacagtaatgagctaaaactgatcatttcaaatcttccccactcatttactttttctaaataattggcaaagtgatccaggtgttctttatcatttttattcagcttacgtttttctatgggcagagtataccaatcaaaagtttttatgattaaatagttgcgaatatcaacaatgtctcgtgtagtatttgctttttttcgaatgatttctaaagtatacttccgtgatcctctattctctctagtagctttaataaaatcttttatctttttatttttctttcgtatgctatcaagttctagatataagacaaattcatccatggttatattcaatttatcaagaaattccaataaaataacaaaaggtatgctattttttccagtttcatatctagataatgtatttcttgttgttatattgtgagctaaatttttttgagagatacctctttctacacgcaacttcttaagcaattccccgctatccatatcaccgctccgttcttttataattgttatgcgcaaattaatcacaaaatgataataatacgtatttttaatcataataacatagtagataaaataaaaacacgggaggtgtgtatttaatattgaaaatcggagataggttgttacttggatggtggatagattgtcgatcgattatttatcccagttctaaatgtttctgcaagcaaagtagttaattctaagacaacaaatgaaaaaatgatttcagattttacggatgaaaaattagatatattcacgaagttgtttgatattacggaaactacaaagttagtaagtacaatagtaactaatgatatgaagtcaagatttcaaatgaattacgcaatagaaatatgattattcatgtaccaaaaagctcgttggatttaacaaacgcaaaagttctacaagttacagaaaattcaaaggatttatatacgatcacggtgcccatagtagatgatgattataatttatttagtaatttgacggttacttacagtcagaatggagaaaatgaaggatatcaagaaactattattagtcgagggttgaacaataaaattcaaattgaatcttatgtaaacggtaaattgatgaaatctgatttacttaatgaagagtttttatctaacgagcaaattaagaaggacatgcaaaatgtataaaagcaaggagttttgttacctcagagtagaggtgttgctgctaaaattgcttgtattgttgttgttcttggtattagtaaatacgttgcgactatcattgcaggagcttgtgttgctccgtgcccagctatacaagttatttgtgctgcttgtattggaggttttgcagctttaggcactgggacgatgagtttcgtagtggcttgttttaaactttgattggattgatgagatgtgaaaaagtcgattaaaactagcagaataattatatagtttctatgtctctttgtagtagcattctcgttgatttttttcaaacaggcagatttggtatgaataatattctacctgtgataaagacagaaatgttaaaatcaaagtttgatggttctgatacttttttattatatgtaggtagaccgacttgcattcaatgccaagaaattgaacctacccttcgaaacatattaaaaagtgtaggagtaaaagccagctactatagaactgatatagctcgaaacgaagatgaaaagagcttagaggaagtagctaaaaagcttgatttaactgtagtaccctcattattaatgatttctaaaggtgttttagttgatagattagatggtgtttacactgcaaaagctatttctgaatttttagaaaataataaaactatttttgaggaggatgcatagttgtttatcctatatatagcatgatacttctaggcttatttttagtattttgtctttacgctctgaaaatacttcaaaaaaataatgatgatacgcgacgacaaatagcacaattaagaaaagatattgagttgatcttggaaaaaattagggaaaataattaaaatggtggatttacgttacttagagaattattctaagcgagtgtttttgttagcggtttcgtttgtctctggatgctttatcagtcctagcgaattaaaattaagtaatttcaattttcgtacattgacaaatgagtgcgagaacaaatttatttttagcttatctacggatagtcaaactattgataggttatccaaagcatatggacaaaagtatctaaacttggattttcttgaaaatcaagggaaaacttcatggtgtgcagcatacgctactacagctattatccgttatcaaactaggaaaagttttcctactgcacgacagatgatgacaactttgtatccaagttcatccaatttagcagatgaatctgcctcaaatatccaatgtattagctacgctaattcttatggatttcatagtatttcaaatagatgggggacagctacagcagaaggaacgatgcttgaaattaatgcgaatcggccatattgggtatctgcgctaaaacaaactagagggaaggataggcatgcgtttgttgttagagggtacgctaactttgatttttataaaactatttccgtatggaatccatggagtaattcaagctatggatatgatctactggacccttccagtcatttgattagtactcatggggtggtattcaaacaagattcaggattattttcttggcattatctataaatagcattaggggtgttaggagtgaagtataaaaaatttcttctcttattctagtaacaatattattatgtacggcttgttcttctcccgctagtcaaccgaagaaaaaagaactagaattatcaaaggaagaatgggagcagctaacttttttttgtggagaatgggtatatacgggagatgaatcaatgtggacaatcaacattgataaacattcaatagacatttcgtatgataaacaccagtttaatggtgctttcacaggcataaaagtaaatgatgggttgacgatatattgtgaagataatcaatgggcctacacattggataagagagatgatgagcgtatattcgttatacgcagtaagctagattctggaacgacttcaaatgcgatgggaatagagttaacgaaaaagccaagaaattagaataattataaatgagagcaaattcaagagtttgctataagacaagtgataaaaacaccatatattaacgaaatgaagagggggtatttcgaagtaaaaaaccatttacctaaaattagaagctaagctttcctttcaaggaaggctttttgttttgttatagaattgcgattgtttatgagctgaatcgttcattttgatgactgaaacactaggatgatgggtctttttcctctgttcattcataatattgaacggtacagctagcgatgctatactgacctcagttccaagaaaacgttaacatttttttgtgggggagaggttttttatgaggtttgatcaattgatcgcagaagaactgattgttttcgatccatcgatagattcaaaaggatcattatttgagcgaataggagatgtgttggaaaaaacaaataaggtaagaaatgttcaaaaagtcgttaaggcactatccaaacgagaggaggagatctccacagggatagaagatggatttgggattccccatgcaaaaagcaagtatgtgacaaaaccagcgctgtgtttttttcatacagccaaattaacggactatagcgggatagacggaatgccaattgaatgtatttttgccatcgtagttcctgaaaaatcagcagatatgcatctagagattctcagcacactctccagacgattgatgaatgcagattttagaaagggaataaaagaagccactacgccagcagatatcatcagacagattagtcaagaatgaaaatagtagagtccttgcccgagtatcaatagtgaagaaaaaggaggaaaataaccatgaaaatcgttggtgtaactgcttgtccaactggaatcgctcatacttatatgtcggcagaaaaattagaagtaacagcaagaaatctaaaccatcaagcaaaattcgaaacacaaggtgtaaaaacagaaaatcagttatctgaacaagaaatcaaagaggcagatgcaatcattcttgcagtagataaagaaatcgaattggaccgatttgccgggaaaaaagtaaagcgtgtctctacaagccgagcaatcaaagaaccgcaagtagtgatagacgaagcattgagaaatattggcgtattcgttgtgtctaatgaaaaagaacaagttgcaaatgagaaaaagccgacaatctataatcatttcatgaatggtgtgaattacatgcttccatttgtgatcgcaggcggaatcatcatcgcactgagttttgcctttgggattacagcggctgatcccaactcagcagactataatgtgttagcagctgcattttcaaggatcggaggagatacagcgtttgccatgatggttcctgcgttaggcgcggggattgctacatcgattgctggaaaagctggttttgccccaggaattgttgccggattactggcctctacaggtggttcaggttttcttggcggaatgattggcggcgtgatagcagggtatatctgtgattttctggcaaataaaatcagcgtaaaaaaagaattttctgctatttatcagctgattgtcgttccccttttatcgatcttaataattggactgttaatggtatttgtgattgaacaaccgatcacatgggtgttggatgctttgacaaattggctgaatagcttgggaaatacatccgggctattgttcggattacttatcggtatcatgatggcagctgatatgggtgggccaatcaataaatcgatttcgactttctcaatcggtttgatgtcagctggggtaaatgcaccgattgctgcttgtatggctgcaggaatgacgcctcccctaggtattgctttagccactttattattcaaacataaatttactaaagaagaacggacttcaggtcaatcatgctggattttaggcgcttcgtatattacagaaggtgctataccgtttgcggtatctgacccgatccgagtgatacctagtttgatgacaggttcagcagttgctgcagggatttctatggcagcaggagtaacttcaatggcacctcatggaggaatttgggtgatgctaattccaaatgtcatgaacaatttacctatgtatgtcttggcaattgcagcaggtacagtcactacagcctttatgcttggactattgaaaaaaacagtgaaagagaaaaaacaagacaagtggacgaaaaatgaaaatctaacaaatgaggtggaagcgtaatgttatatacaatgaaagagttattgaaagtggctaaagagaatcaatttgcagtaccagccttcaatatttgcagctatgatatgatgaaagcaatcatcgaagaagcagagagattagaagcaccagtaatcttagaaattcatcctgatgaaatcgcctatttgagtgatgaatttgttgcggcagtaagagcttatgcttatacaagtaagctgccgattgttatccacttggatcatggcggtacgatagaagatgtcttacgggcgattcgaaacggctattcttccgtgatgattgatgcgtctttgaaatcattcgacgacaatgtacagattacgaaaaaagtggttgcgttagctcatgcggtaaatgtctcagtggaagctgagcttggaacgattgggaataatggttctgctgaagggggtgctgaaacaatcatttatacagatcctgatcaagcgaagatttttgtgaaagaaacaggaatcgatacacttgctgtagcaattggaacagcgcatggcttgtatccgaaaaacagaactccaaaattaaatatcgacttactgaaagaattgaaccaacaaatcgatcttccatttgttttgcatggcggttcaggtaatccggacgcagaagtcagcgaagctgtaaaatacggagttgccaaagtgaatttgagctctgatcttaaaagtgtctttttcaatgctttgagagaaatattgagtgaacatccatcgatgtacgagccgaatgcaatttatccagcagctaataaaaaggtacaagaagtagtcaaacataaaatggaaattttgaacacagtaggcaaggctagtttatactaaaaataaaaatgtgtaatcaaaagggtgtgacaatagtcttgtcataccctcttttggatacatgatgttcagaagtagttttttcgaaaagtttcttcttacttcttgaagccaatcacttctgtcacaacctcttttttcctgttactatataaagtaaatggggtgattttatgttgaatgaagtggagaatagacagcaggagattgtgaattatctaaaaaacaatcaatttgcaagagtcatcgatttgatcgagttagtaaattatagcgaagccacgattaaacgtgaccttgtttttctggaaaaaagtggattgatccgtagagttcgcggtggcgccatgcttgttgacaatcgaaaaattgacgtgccttacctgatgaagattaccaaattagaagaagaaacagaaaaacgtaagattgcagatacagcttcttctttgattcgagatgatatggtcttgttcttggattccagtacaacctctttacatttagtccgaaacttagcaagatttgatggtttgcagattattacgaatggcatagtcacagctgctatgttgagtgaatacacaacggcaaaagtatctgtactgggtggggcaattgttccgaaacgagcaacaatcaacggttcaaaagcttataatgatgcattgtcatattatgcggatttagcggtaatcagttgtcgcgggctagatttcagccaaggagtaacagaaactcatgaaggagaggcaatggtcaaaaaagcttttagaaaacaagcagaccggcttgccgttttagttacacagcaaaaaatcgcacataaattcatgcatcaagccattgcttttcatgaaatcgattatctggtgacaagtaacgaactggcaaaagaacagtatgcgaaagtaaaggaacaccatatcgaatgtttgtatggatgaattattgcgtgaatattctaaggtgttttcccatttttcattttcttagataggatcttatctttgctcgcttctcttagccgatggtataataatgaaaaggttatcttgttagataatcttacttttttatccaggagaaaggagtgcagaaaatgaagcatgtgaaggcgttggtagtgaaggcaatcatgatctgggcaattctgtgggtcgtgctgaccggtttatacggtgttagctttatggattcaacgattgttggggtaattatcgtagtgatgatctatgtgctaggggatttgttgatcttacgcaaagtagggaacatcgcagcaacgatcgcagatgctggttcagctgcagttatcttgtggctctatctatactttatgaatgatacagtcgatatttggatgaaagtcttgattcctgctctattgatcggtgtggcagaatggttcttccacaagtggttgttaagtcaaggaatcgtaccagacgaacgaaaaatggaataaagcatcagttgtttttatcaaaaaaccgctcagatcattttcagatctgaacggtttttttatctattcatcaagatcaaatttcatttttcaatgattcaatcaattcgccctctgcttcatgactatgttttcggccattagcgagatagagcgctgtacatatcaatggaatgactccggcaatcacatacaatcctctaaatgaagtaagagattttagcatccccatcaaataaggaccaacccctaagcctaggtctaaaccaataaagtaggtagacaaagcaatactgatgcggtgttcttttacgatcttcaaacagacagcttgtccatttgacatgaacgtaccataacctaagccgactaatgctccagaaataagcaatgtcacactatttgtcgttacactcagtaaaaataatcctgctgttaagaataaatagctaggatacatcacgtattgttctcctttgacatcgaaaatccttccagtcaatggacgtgtaaatgtgatgaccaaagcatatacgacgaagaaaaatgacccagcatcaactaagtggattacttttgtataagaagataaaaatgataaaacacttgaataagaaagacccatcaaaaaggcgattcctgtaatgaaaagtgctttcttttcaataaagctattgatattccatgaacgaagagatgttttttgttcttcagataatggaatattttttacaggaaagacaaggcaggcaatcgtaacaaagaagaccagtacaattgaaaaccaaataatgaaacgaaagtcagtcatgttcagcaaaatcattcctaaaaatggtccaacagcggcagctaaactagtacttaatccgtaataattgatgccttctccttttttagatgcagggatatatgcagtaacgatagcatttgtagctgtagaaactgtaccgtaaccaaatccattcaagaatcgaactaaatacaatgccccgatagttggtgtataaagataagctaatgttgtcagaagatagaaaatcgcgccgcctcttaaggtaaacttccgaccaaatagttctaactgtttccccatgaataagcgtgccagcaatgttccgatgatatatattccagaagcaaaacctgcttggctcaagctggcgtgtaatgtgtcttgcgcaatgactgccatgatgaccatcaacagataataaattaggtagacaataaaattgatcaatgtgattccgataaaatatttattaaataatttcttttccatgtatgttatacattccccttaagctgaatatgcttttaatttttgtatttggacttctacatcgtgataattggatggatagcgatcaacaagttggcgaataaataaatcccgtgtagacataaacaggtttaaaaattcttcgcattcgtttgttggattctcatccactgctttgatcaattcgatcgagttttgatacgcatcatttaaaaagactaaagaagctttcatgtcaaatcttgtttgatacgctgtttctaatcgattaatgattgtgttcatccagtaattcatgttttttccctctattcttaaaaaattttacttctgcagtataacgaataaaaaaaaggaaaaaaatcgcataagtgatagaaaaaggtacttaacaaatgttaatatcattagtaaaatacctttggactttaaaaagttttaaagtactgtatgatctttttagatgaaagtttggatgggggagcatcattggatagtagagtcttaaaggaatatttggataaaaatgattttccgataatacgcaaaggatatcataaatatttgacattcgaagggatggaagattcccatacgtatatcttgaaagagggaacggtaaaagcaagtgttatttcaaatgatgggagagaatttaaccttcgctatatcaaagatcttgaaatcgtctctcttttaaaagacgaatattcacaattcatcgattcgccgtataatattcgagttgaatcagaatatgcagagttttatcgaatcaatcgtgtgcgattttggcaaaatatcaaccaagacccaaagctgcaacactatgtaaaagagtattaccgctatcgcttgctttattcgatgaaaaaaatgcaacaaatgctgttaaatggaaaactgggagctgtttgtacgcaactttacgaattatatgatttattcggcgtgcgaacagaagaggggatgttgatcgatttttcgatcacaaatgaagaaatcgccaaattttgtggtatttcaactgctagcagtgtgaacagaattttaaagcagttgaaaaaagatggtattatcacagtgaaagatcatcatatcgttattttgaatatggacttgttagaagacaatattatcttttgatgaacaaagaggttgtaacagaagtggtcagcttcaagaaataagaaggaatttacgaaaattgttactcaaatttttgtcaaatttcggcttattttcgaagaagctacttctggaacaccgtgaataagaggttgtaaaatcagcgttttgagctaataccgaggatcagctgattgaacaccgtttaccaagaggttgtaaaaaagctgttctgcatcaagtaataagaacagccaagtaaaaacagctcctaatgtttttaacttggctggacttattaccgcggatgcaagcttttgaacaccgtttattcgcaacaaaagggctgtgacaaaaatcgtgtcacagccctttttgcgaacattcatttagttatttttagaaacttctgccgccaccgccaaaagtcccgccaccgctagagtgggtagtacttccgccaccgccgcttccaggaggtgggcttttggggattcttcttgtcgtgacaaaagaatttgtcagacgatcggtttttttagttaatttgatactggatttttctcggaacggatatttgtagatgcctgacttcaattgataacgcgaaacagtcacaaaataaaagacaagactaaggataagagccaaaacaacagcaatgatgatttccactgtcgtcaaaactttatagcgtgtgattttgccagtttcttcatctacacgataatgtcctcctggaactccgtcttccacatatgtggctgatttagacaagtacgcttttgcagcatcgtagtaggcagcattcgtcatctgatcataaacatcatctaagatcgaatcgattctactgtcagtcaaataatcgatcatattaccagaagtcgaaatgtagatttcacgctgtcccatatccaatagcaaaactgagccattttgatcatttccgactgcctttcttaagtaattatcggcaaagtctcttggttcttctgaattagaagtagttgtgacgatcaagactcgtcccttgattttttcattcagcttttctgcctgttgttccaaagattggatttgatctgtagtgaacaacccagcctcgtcatttaccgttgctgtatccgcatgagtagccactggccaactaatacttactagcaaaagaaagaacaaaaagaattttttcatcatatcaagtaacctccgatcagaaagaggatcgctagtccaacgaaaatcccaagagcagtcagtcctaattttttctggctaatcggcaggacaccgctgacttttcctgtttgtccattcattgcatagtagtagacttttttacttgagtcattgcttcgataagtaacgagccataccggcaacaatacgtaattatttacttcatttgtgattgaagcagaggttcggacacctgtcaaggttgtatacccattggcagtatcttttaacagcttctctgaatagtcttttaattcagattggatttgcgatttgattgcctcgtattcgatatctcttttttctgcttggaacccggctaaatactggcttttaaaatcaattgctttatctaacgggaaaggttgcacaccttcgaccatcttttgttgcgtattttttgataaggcattttttactagttctttaaaagaaagcttgcctgctcttgaaacagcaaattgcttcgtttctgtgtattcgatgtcacctattcgccaaatgcggataacggtgccgtttgcctgcattgtgccatctacttcagcatctgtagcccaataagggaaatatacacccgtcagcttatcgatttggtctttattgaaaaaagcttttggaacaaaccattttttcttggtccaagcgagaaatctattgattgcttcttctttctcgacagcaaaaggaagtactttgtttggcaagaattctccgcttaaacgtcccgatagtacgacgggattatggcagtagtaacaataagtcgcagcagtggtcgcatcggtcacaatctctgcaccacagttgggacaaaggaaaagatccatcgctacagtattacctgcagcttcgtccgttgtatctgaaaaaccgcctgcctcgtcaaacgctttacgctcggcttcactcatgtcggtaagctgttcttgggctgtaaaagtaaaatcttctgtaggcgaaggttcttctttgttctcttcgccagccatacgcgcttctttttgcttctgctcatattggctgacttcttcttcggtatagatattcaggcagtattcgcaatgaaatttttggtctttaggatcaaaagtcaacggaccgccgcaattaggacatttatgtgtcagaacatccatcagctgcacacctttctcaataaattaatcaacggggattcctttaaacggtttgccgcagtttggacagaatttagggatgccgttggaaagatccacgatctcgttgcattcgctgcaacgcatctgtagcttaggctgagcgttttctactggtttggcagcgccacagttggaacagaattttccggaattttctgtcccacagactggacacgtccaagtatctgcattcccttgtgcggcttgttgattttgtttttcagcttgttgcttgatttgttcttggttgttttgagccgcttgggaaaggtaagagccatttgcattcattcccatacctacgcccataaagccagtcattgctcctgcttcattttttccggctgcttccattccacgggcaatggaaccttgtacgtatccttcacgcacgctaggatcacctagcattgccccttcgttacgcatattgattagtttcacagaatcatctgtgtaagaaatgctggccacagcgacagagacgatctccatccctcgcaactcgcgccaagaatcatccagtgcagtatccatgtatttgcttaactccagactcttagatggtacataagaaatccgttgtccatccgcagacatctgattgattgctgattgcaatgctgttaggaattcagctaagtattgctcgttgatatcattgatttctacttgtgttttgtttttaggaattgcgtttgtataaaataaaatcgggtcaacgacatgaatagaataagtaccatgtgcccgtaagaataattctgcgttatagaaattatcaaagtagttcaatggcgcactcgtaccgaatttgattccctttatttcttggaggttgatataaaaaacttgttgtttctgcggtgtaacgccaccaaatttaaatcggtcaaatgtttcagcaattgcttctttcagtgttccgttgaacatggaaggagctgcgtcgtttttaatggtgtaatacccttcctcagcggtataatcaatgatttttccaccatcgactaaaagcatcatcatgtttggatagacatggacgactgttccgtctgtcaaaacatcttctgttcctttacgattggagccacgtttgtcatctttgcgaactttgacacctttcgtcataaccgttgtatcactcatattgtctggttcgatggcttctagccattgatctgccagaccgccgccgaccatacttgttgctgctttgataagacccataaaaaattcctcctctgattcagctaatgccaaacaattattgtttatttattataccataggaagaagtgaaacttctcggactagagacggaattgaaatggaaacttgcgtattgattaaatacctgaaaaagccgagaaggatagtagtttttttccccaatatcacgtataataagagatagtgaattttttaaaaaagggggatccttatggcatatcaagcactttatcgagtctggcgttcgcagcgtttcgaagacatcgttggacaaaaagctgtgacacagacactaaaaaatgctattgtttcccacaaaacctcacatgcctatttgtttacaggacccagaggaaccggaaagacaagtgcagcaaagattttcgcaaaagcaatcaactgtccgaacagtaaagacggtgaaccatgcaacgaatgcgaaatgtgtcgatcaatcactgctggtacacaagaagatgtgatcgaaatcgatgctgccagcaataatggagtcgaagaaatccgatttatccgtgatcgggcaaattatgcgcctacaaaggcagcgtacaaagtgtacattattgatgaggtacatatgctttcaacaggagctttcaatgccttgttgaaaacattggaagagccaaaagaaagtgtcatattcatcttagcaacgaccgaacctcacaaaataccagctacgatcatttcacgaacccaacgatttgattttaaacggatcaatacggcagatattgtcgaacatcttgaatttatcttaaaagaatcgactatcagctatgaaccagctgcattgaatgtgattgcccgttctgcagaaggcgggatgcgggatgcattgagtattctcgatcaggcaatctcatttagtgaaggaacgattactttagatgatgccatgcaagtaacaggcagcttgacagacgaaatgatggacagctacttgagtgcttgcgtgaaaaaagaagtaccagaagcattggaagcgttgaatcaaattctcgcagccggcaaagaatcacgtcgctttctagaggatatgttacaatactgccgtgatctgctgatgtatcagcaagcgcccaatctagttgaagaacaatcaagtacgatcagaagtacatttacagaattggcacaaactgtttcagcggaacagctattttcaatgataaagattttgagcgatacacaaaatgaaatccgatttactaatagtgccgctatttatttggaagtcgctacagtcaaactcgcacagctaccgtctgcttctgttccttcagcaaaaatggcatcagcagatgatcagatagtaaaacagctgcaacaagagatcaaggaactgagaaacgaaatcaaagaacttcgcagtaacacaggaactgcgaatacaaaagtacagccagtacagcaaacgaatcacaaaaaacaaacaagtacgtatcgggtaccgacggaacgggtatataaagttctgcgggaagcgacaagacagcatctgaaccaagtaaaagaagtatgggaagatttgctgatgagcctctctgtcactcagcgggcaatgcttaaagcaagtgaaccagttgcagctggccctacaggattagtgattgcatttgattatgagattgtttgtcaaagagcagcaaacgacgaagaactgcagctttcggtacacaataatttaagccgaatgatcaaagactatgcgcctgatccggtttatatcacaagagaaagttggccggaacttcgaaaaaattatttgacgcaagcacaagaagagggaacagaaaattcttttgcttctgaagaatcagaaggagaaatcgaattactccctcaagaacaggaagtaccagaagaaacacttgtagtaaaagcagaggaactttttggttccgaggctgttacagtagtagatgactaagaaaaaaggagtagataattatgatgcgtggaatgggcaatatgcaaggcatgatgaaacaagtacaaaaaatgcaaaaagaaatggcggaagcacaagagctgctaaataaaacagaatttacaggtaaagccactaatgaattggtcaaagccgtatttacaggtgatcgccgcatgaaggatatccaaatcaatgaagaagtcgttgatcctgatgatattgagatgcttcaagatcttgtcgtaatggcagtcaatgacgcaatcacacaaattgatgtggaaactgagaaaaaattagggaaatacgcaaaagggttaccaggattttagttttaaactgaaggagtaatgaatatgcaatatccagaaccaattgcgaaactgatcgacagctatatgaaacttccaggaatcggccagaaaacagcgacaagactcgcgttttatacaatcgatatgaaagatgaagtagtgaatgaatttgctaaatctttgttaagtgtaaaacgagatttacacttttgcagtgtctgcggaaacatcacagaagaagatccttgcgaaatatgtagaaacccttcacgtgatcgcagcattatcctagtggtcgaagagccgaaagatgtaatggcgatggaaaaaatgcgggaatatcacggactttatcatgtactccatggtgtgttatcaccgatggaagggacaggtccagaagatatcaatatttcttcgctgctgcagcggctgcatgatgcagatgtaaaagaagtgatcatcgcaacaaatgcgacaacagaaggagaagcaacagcaatgtatctctcacgtctaattaaaccagccggtatcaaagtaacacgtttagcacatgggttgtctgtaggctctgatatcgagtacgcagatgaagtcacgctattgaaagctgtcgaaggaagacgcgagttataaatttctaattaaatgttttttcagatacaatatagaagcagcataagagatgggggcaacaatgtgaacggactatttattacaatcgaggggcctgatggtgcagggaaaaccagcatcttgaatgaacttttccctcttttgaaagaagtagcaaaaacagaaatcattcaaacaagagaaccgggaggcatcccgattgctgaagagattcgagcggtgatcctggatccaaaaaatgatcggatggatgaacgcacggaagcactactttatgcggcggcaagaagacagcatctagtcgaaaaggtcttgcctgctctggcaaaagggaaaatcgttttatgcgacagatttgtcgacagttctcttgcttatcaaggtgcaggccgacgcatcggcgttaccgagattgctcggttgaatgagtttgctacagaaggtactacaccagattttaccctttatcttgacgtagattcagacaccggattaagaagaatcaagaaaaacagacaaaaccaaatcgaccgtttagattcggaaggtttggaattccaccagcgtgtacgacatgcttacttaaagctggcagaagagaatccggaaagaatccacaaagttgatgcaagaaaaagctttgaagaagtgctgcaaacaagttatcatacaattattgaacaatatccgcaattttttgaaaactaggaaggtgaacgtttatgaaaattattttagcgattatccaagacaaagacagcaaccgtttatcaaatgaattgattgatgcaaatatccgtgccacaaaattatcatcgacaggcggcttccttaaggctggaaacagcacgtttatcgtgggtattgaagatgatcgagtagaagaagcattggaaatcatcaaaaaaacgtgtgaatcaagaaaacaatttgtatctacacctgttacattggatatctcgatggatgggggcgtcccttatccagtagaagtagaagtaggcggtgcaacagtcttcgtcttacctgttgaaggattccatcaattttaggaggagctgagctatgaatcaagaaataaacttggctcaaatgcaaccgatcgtgtatcagcagcttcaacagagttttgagcatgggcgtctcgctcatgcttatctttttgaaggagaaaaaggaacaggaaaatatgaagtaggtgtgtggctcgcacagcacctgttctgtacccaaatggaagacaatcagccttgcggaaaatgcaacaattgtcagcggatcgaaaagaaagaacatccagatgttctggttatcgaaccggacggacaaacaatcaaagttgaccagatcagacgtttgcagacggaattcagtcgcagcggatatgaatcaagaaaaaaggtttttttgattaaagaagctgaaaaaatgaatagcagtgcggcaaacagtctgttgaaatttttggaagaaccaccgggagattttttagcggtattagagacagatgcagtaggaaggattctccctactattcaatcccgttgtcaagtgctgcattttcaagaactttcaaaagaagcattgatccatcgattgcaagaagagcagattccattagaaaaatcaaaacttttggctttcttaacaaacagtttaggaaaagcagttgaaatctctcaagatgaatggtttaatgatgctaaggacttgatttatcaatggttcgtttacttgcaaaagcaagacactcaagcctttatctatgtccaaaaaaaattagtgaaatcatttaaagaaaaaacacagcagtttacaggattatctgtcctgatgttttattatcaggaagcacagcgtcaagcagtagcgaaaggcgaatatggcaaagtgaaacagataaaccagataattgaacgaatattgatcgcagagcagaaactacgtagcaatgtcggttttcaagctgttgcggaacagttcgttttgcagacgattttttagcttgccgcagaggacgagaatcaaggaggatggaaatggtagaagtagtaggtgtccgatatagagatgcaggtcatatctattattttgcaccaggagactctgaatatatttataatgacaaggtattagtcgaatctcagcaatccttacatattgctactgttgtccttcctaaaaaagagattgatcccaatgaccttcctgaagctattcgtccaatcttgcataaagcatcaaaagctgaactagaaaaagacaaaaaaaataaagaagatgcgcgtgatgcattgcaaatcgcaaaagaaaaagtgcagttgcgtgagctggaaatgaaaataatcaaagctgaatatacatttgatcgaaacaaactgattttttcttttacggcggacgggcgaatcgactttagagaattggtaaaggatctagccgctgtatttcgtactcgtattgagcttcgacaaattggtgtacgcgatgaagcgaagataataggcggaattggtccatgtgggcgtccattatgctgttcttcttttttaggcgatttcgtgcccgtatcgatcaaaatggcaaaagatcaaagcttatctttgaacccaacaaaaatttccggtttatgcggacgcttgatgtgctgtctacaatatgagagcgaagaatacgagacagcaaaaaaagaactccctgactttggaaaagtaattgttacacctgatggtaaagggaaagtcgtagggttgaatctgcttagccgtatcgttagtattcggctgactggacgggaaaatcctgtcgaatatgaatgggatgaattgaaagaatttatccaagtaggtgagataaatggataagagatcattatacgacggattgaatcagttagaatcagagttgagaaatacattaacagaacttgttgaaatgaagcatgctttgcatgaaatcgtagaaaaaaatacgactttggagatggaaaatcaacgtttgcgagaacatcttcgggaattgaaccaagttgcacaagctccagctgaaaatgtgaagcaagaactttccaagtctcgtatgaatcttgaaaaaatttatgaagaaggcttccatgtctgctacgatttatatggatcaagacgggacaatgacgagccttgtgcgttttgtctagaagtgatctatcgcgaaagcggtcgatgatcaataacaagaggagactggagcggagaaagactgctccagtttttttattaaggagattgtgacagatgtataatcaaaaaagtttcaaaggaaatccagtatacgggaatttatatcttgtaccgacgccaatcggaaatctagaagatatgagctacagaagtgttcgtatgctacaagaagcagaccttatcgcaagcgaagatacgcgtaatacacaaaaattattgaatcacttcgagattcatacgccccaaaaaagtttacatgaacataattataaagaacgtgtccctcaattgattgctttgttaaaagaaggaaaaacgattgctcaagtcagtgacgcaggaatgccttccatcagcgatcctggacatgagctagttttagcctgcataaaagaagggatttctgtgatctctatcccaggacctacagctgggatgacggctttgattgcttcagggctagtgcctcaaccatttttattttatggcttccttccacgcaagaaaaaagaacagaaagaaacattggaaaagctaaaagaacaaacagctacgctgattttctatgagtcaccttatcggatcacagctacgttgacgaatttcttagacatttttggtaatcgccaagtcgttttgtgtcgagaattgacaaagatccatgaagaataccttagaggaagtacagaagaactacttgcatatatcgaagaacatccagtaaagggggaatgttgtctgcttgtagaaggaaatttgtttgaaacgacagggacagaagtggatgaagagcagggatccttaaaagaacaagtagaagcaaagattgcatcaggcgaaaagccaaatgctgctatcaaagcagtagcgcttaaaaatggactgaaaaaacaagaagtttaccgtcaatatcacgaattagactgaaatagtataagtagtatacaatgaagcgacaatgtggaaaacagctactaacttctcaaacctcttgaacgcgaacgaacgttcctgtataatggctaagaggtgaggatgatggagctgcaatttcctttacataatgatacatcaagaaaaatcattcatatcgatatggatgcttttttcgcttgtgttgaagaacgagatcatcctgagtttcgtgggcatccattagtaattgctagacatcccagtgacactggtgggcgtggagtagtgactacggcaaattatgaagcaagaaaattcggaattcattcagcaatgagtgcacaaaaagcgtatgaactttgcccgcaagccatctttaagcctggcgaccatcataaatacagcgagatttccaaacaagtacgggaagtattctatcattatacagacattgtggaaccagttagtatcgatgaagcgtatcttgatgtgaccgaaaacaaaatcaattgcaagtcagccatcaaaatcgcccgaatgatccaggcagatatttgggaaagagtccagctaacatgttctgcgggagtaagttacaataagtttttggccaaattagcatcagactatcaaaaacctagagggatcacagtagttgcacctcaagatgctgtgccatttttaaaagctttgccaattgaaaaatttcatggagtaggaaagaaaactgtacctagaatgcatgagttagggatttatacaggaaaagacctatatgaatgcacagaaatgatgttgattcgaaattttggaaaaatgggctattctctttatcgtaaagtgagaggaatccatgattctccagtaaatgttacaagagagcgaaaatctgtgggaaaagagcatacgtatggacagccattgcaaacggaggaagccgtgctggctcagttgcgccaactagctgaaaaagtagaagaagcactgagaagagtccaaaaacatgggaaaacagtggttttgaaggtcaggtacacggattattctactgtgaccaaaagagtgacattgccagaatacatctataaaaaagaagcgctcttttatcaagcaagtcttatatgggaggaaatcttgggagtagaaaaagggatccgattgttaggaatcaccttgacgaatcttgacccgatgacctatgaaaatatcgtccttccgttatggggaaatcaagaaatataaaaacagctttgagagttgaaaatggaaatccgttttctctctcaaagctgtttttatatcaagtcttgttttttgatttgttcataggtttctgttgcatccgtacatttttcccaaatcataacttggttggattctaaagatttttggacatcaatgattcgctggttgctgcttccgcgaaattgtagttttaggtcacgtttgctcaattcaaagcgtccgtcaacaaggatatcgatttgcgaaaggagttctaatttatcttctgaatcttgtagcaattcatcaaaggtatagcctgtccatgaccagatatcttttgtcgtaccgaactcttttcggatacgtcgtacgacttgcaaacaaacatctgtattcaaaaaaggctcgccgcccaataaagtcagtccttgtacgtaatcgttgcgcaagtcagcgatgatttgttcttctaattcaggtgtgaatggtttgccatatcgaaaattttgcgccgctttgttgaagcaaccttcgcaggcgaataagcagccactaacgtaaagactgttacggacaccttcaccatcgacaaaattaaacggtttgtagtcagcaatatagttttgactgtagtcttttgctaaccattcttttggttttggatttctcataaaaaaacttctttcatttaaggttcaaagatatagctattgaagataaaatctactcgaccacataaataagaacaaactgacctaaatccattgttcaagaaagcttgttcttattttgatagagggcgttcaaagatacaaagccatcgaaagagggtggtgaaaaaagacttgtcacagcctcttattctgaataaacggtgttcaatcagctgaccttcggtattagctcaaaaaacggtaaaataggaggagccatttttccattttgtttctctaatactcaggtcagggcgctgatttcacaacctctttcttaaacggtgttcaaaagcttgcatctgcggtaataagcccaactaaacgaaaaatatgaggagctatttttgtttagttgttcttattacttgatgcaggacagctttttcacaacctcatttcatgtgtttcacacgtgaggaaatttctttgtggcgaccatgtaccatcggacgagcttgtggatttcctaaataaccacaagtacgtttgactacatcacatgtttttgggtcatgatttccacattctggacattcgaagcctcgttctgttggtttgaaatcaccttcaaaaccacattgatagcaatggtcaattggcgtattcgtaccaagatacccgattttatcatatgcaaaatcccacacagcttctaaggctttcgggttttgttggagcatagggtattcacagtagtggatgaatccacctgaacaatattttggataatccttctcaaattccaatttttcaaatggcgttgggtttttacgcacatcatagtggaaactgtttgtataatattctttatctgtgatattttcgatgataccaaatttttctgtatctaaacgacagaaacgatcagtcagactttcacttggtgttgaatagacgctgaaatgataaccgtattcatcaccccatgcatccgcattggcttttaattctttgacgatgtcaagtgtgaaagcttttgcctctgggtttgtttcccattcgccaccaaagaaagctgaagcaacttcatataatccaatgtagcctaatgatacagtagctcgacggtttttgaataattcattgacagaatcggtacgtgaaagacgttttccgaaagcaccatacatgtataagattggcgcatttgctggaatggcttctttacaacgttctacacgatagagaagcgcatctttcatgatttctaaacggtcagacaatagctgccagaatttgttctgatctccttttgattcgatcgcgattcttggtaaattcaatgtaaccacacctaaattcattcgtccgacatttacttcttgaccattttcgtctttccatccttgcaagaatgaacgacagcccataggtactttgaaacttccagttaattcgacgattttgtcgtaattcagaatatcaggatacattcgtttcgttgcacattccaatgctagttgtttgatgtcgtaattaggatcttcagggtttaagtttacacctttttttaaagtgaagatcagtttagggaagatagctgttcgcttttcactccctaatccattgattcggatctgtaaaatcgctttttggatttctctttcaaaccaattttcccccaaaccaaaccctaatgaagtgaaaggggtttgcccatttgaagtaaataaggtattgatttcatattccaaactttgcatagcatcgaagatatcttttttggtttttgcttttgcatattctttttggcgttctggcgaatcgatccattcttccgcgtcttttagatgttttttatagttcaattctgcaaaaggagccagcaattcatctgttcggtcggcagaacagccaccatattgacttgacgcaacattagcaatgatctgtgagatttgtgctgtcgctgtttggatagatttaggtgattccacttccgcatttccaattttgaaaccgttgttcagcatacctttgaaatcaatcaagcagcaatttgtcatcggtgtgtaaggatgataatccaaatcatggtaatggatatcacctttttgatgggcatttgctatatgtggcggcaacattttcagtccgatcgattttccgacgatgccggctgttagatcacgctgtgtattgaaaacattactgtctttatttgcattttcattcacgacagtctggtctttgttgattagtttttcaatcgaaaagttgatatctgtcgctttactgcgagcaaaatcccgttttgtacggtaattgatatactcttctgctaattcatattcgtttttttctaataaaatatgttccacgatgttttgaatctcatagatcttgacattttcagcaaaccggcttttgatttcttggacaaccaagtctgcaatcatttggattttttcgtaagtaagtggggataatgagccgtgaattttcttttcagctttgattagtgcttcgttgatcttttgttcatcgaaatcaacatggcggccatctcgtttgataactttcatctggtgtgcctctggttgctgagtaacgactgttttctcttcataatttactttcattatcttcaactcctgctaaattgttcttgtctatcataaaacaaaatttaggaaggagcaactaattatcggctatatatagtattcaatccgctgtataattggatttctatactatatgtagtgtatattttattgtgaaaaaaagtgaaaacttgtagttgatggatttattttttgcatatttaatttagctgaataaaataattgaataaaatttttttatttgggctaagaaaaagtgacaaaaacataagagcaaattgttcgtagatatgctactatgcaaataaacagaaatgaaagaggagaagaagaattggaaaagatgatcgaagtgaaacatctcagtaaaagctacggtagcaaactttctcccgtcaaagctttagataatatctcattcacagtagaagaaggcgaatttgttgggatcatgggtccaagcggtgcaggcaagacgacgttgatgaatattttatccacgatcaatttgcctacgatgggtagtgtcttgatccaaggaaaagaaatcacaaaaatgaaaaatagtgagctcagtgactttcgccgaaaaaaactaggattcatttttcaagaattcaatttgatcgatactttaaatgcaaaagacaatatcctattgcccctagcagttgaacggatgactaaggaagagatggaaaagagagtaagacacgtagctcaattgttgaatatagaagaactgctaaaacgatatccagatgagctttctgtcggtcagcgacaacgaattgcagccgctagagcccttgttgttcagccacaagtaatctttgcagatgaaccaactggatctctagattcgaagtcggccacagaattgttgaattatttacagactatgaatcaaaaagaaaaagcgacaatcttgttagtcacccatgacccatatacagcgagctactgtgacagaattttatttattaaagacggcgtgattttttcagaagttgtgagaagagggacaagaagagaattctttgaaaaagtaatcgacatgcaggcgacgattggtggaggaggaaaaatgaatgctgtataaattagccgtcaaaagcttttttcggcagtcccgagggtatcttgtttattttttcagtttgactttatccgtgatgatttattattcattcagcgcaatgacctatgatcaatctttagttagaagagcaagtccagatacttcgatagatgtcggattgagttttggcggactgatcattactgtcgttttactttttttcgtattcagtgccaaccgattttttttgaatagaagacaaaaagaaataggtatctatcaactttttggtatgaacaaactacaaatttcaggtatatatgtattggaaatcatgataattgggttatttgcctgtatttttgggatattgctcggcattattttctccaaactcttttccatgattttggttcgaatgatggatatggatcttaatagtccgttttttatctccattccatcagtcgcagatactttatttgcttttttcatcatccttttagcagtatctgtgtattcgatatggaaaatctggcgctacccgatgattcgaagttttggagaaaaagaacaagcagatagttcaacgatgcgtttcagaacaaggcatcgattactcgctgtcattgggttattgcttttaacgagcggatattttggggctagtcattttagagaaatcacttcatggatgatcagtcatcattaccttgagacattcattctctttttgccttttctgatctttttcatttgtgtgattggtacttatttgtttttctgctatacatttcggctctttttgatcatattgagtaaatggaagctctattactatgggatcaattttttaataataggtaatacacaagtgcacctgctaaaaagctggcggacgaattctctaattacagtcattcttggaatttctttaatgacgattggcggtacggctagtatttctactattttatcgtatcaggagaaagtatcctccccgatggactatcagtttgatgtcgagacagaaaaaaaaatcaagcctattctggcagaggaaggacagaagataactaaaaaaatcaccttgcattataaagtcataggtggtatctacagaccagatctcgaagaacctatgtttcaaactgctaatctgatcacagaaacagaatatcaagccttcagaaaagttaatccggatttgccaaacgtttctttgaaatctcctaactatactgttttgcttgatcaaatgcaaactcttttccggaatatttcattatatggttctagtattggattgccagataatcaagagttgaagattcaacaaatgcttccaagtgtattaggtgacgaaacgatggtatatctaagtcctgtactagtcgtggatgataacgtttttgaaaaagcaaaaggtgtagattatcaagtagtcaatgtggatgtgtcaggtgggaataatgaaaagatagatgaacgactgagcagtgaaatgtcgataaagtggctcaatgctatttattattcttatgatatcgtaaatgggcgtctgcaaggagaaattagtacaaagaaactgccagatgacaaaatgaaggaagcgcaatttagtcaagaaggttctcggttgaacttctcctccagctattcaaaattgcgtgcagtcaaccggcggattggtatcaatatttttgtcacactgtttgtcggaatgatcgtcattattgctactggcagtattctgaccgttcgacaattagcagaagcagaggaagaaaaagaaaattatcacctattgactaaactggggataccacaaagaagaattagaaggatgattttcgagcaaaacgcacttaccttttttccacccatgatattaggaatcactcatgcagtatttgcaatcaatgttttcactcagtatatcaaaactgccgattattggttggcttatcttgtcagtggcttattgatccttatctatcttttgctttatgtcattacgagtcagttatattgtcggattatcgaggaatgacaggcggaataagacaagataataaaaagtactaaattttaaacaccgtttaaagaagagattgtgaaaaagctgtcctgcatcaagtaataagaaacagccaagcaaaaatagtttcccatgtttttgatttagctggacttattaccgcagatgcaagcttttacacaccgtttatttggaagaagaggttgtgacacgctttttgtcacaacctctttattttttatattttttaaaattactagaaattataaagaaaaaagcagcgttttgatgtgctatttttataaaagctatgtgacaaaactgttagtaaaaaaacggtttctgtaagctagacacatgtttctttttgtcaaaattcgttacactttgtgtgaggttatatgaggagggaatccaatgaacaaatggtggtctaatccaaaattgaattattggggaaaattcatcattcgaacaattttttatagtgcggtactgctgttcctgatctacctgtatcactataaaaatattcaaggaggaacatttatctataacgaattttaggaggaagagtatggaaatcaaaacgattattgaagcagtcgatgattggggaataagcgaacctgatcgaattgcttatcaggcggatgagatgcatacttttggagaattgaaacaagcatcagacgcacttgcttattatttagaagaaaaggtagaaggggatggaccaatcgtcgcttttggtaatttagaatttgagatgattgttgcatttctaggaattgtcaaatctggtcatgcctatttgccaattgaagaacacacacccaaagaacgtatcctgtcgatctttcgggtggctaaaccatctatggtcatcagtattgggaattggatagaagacattccttctgttcctgtcgtaacaaaagaagaatttcaagaaatcgagaagataccagtagaattttatcccagaaacagcgtaaaaggtacagaaaatttttatattatttttacttctggtactactggagaaccaaaaggcgtacaaatcagtcatgataatctagtcagctttgttcaatggacgatggaagactttgggatcaagcctggtatgcatttcttagcccaagcgccattttcttttgatttatcggtattttctatttatcctgcattagtttctggtggaatgctgaagccgttaaataaagcagttattcaagattttcgtcaattattcgcgacattgcctaacttgaagttgaatatttgggtttctactccatcttttatggatatttgcttgatggagcctaccttcaatggagaaaatgtaccagaattggacatgtttttattttgcggagaagaattgacaaaaaaaactgcagaaacactacttgatcgattcccaaatgcacggatatataatacttacggcccaacagaagcaactgtggctatttcaagtatccagattaatcagcacgtactagataaatatgaccgactaccgatcggctatgtaaaaaaagacaccaaagtttctattgtccaagaagacaaacttgttccaaaaggagaaacaggtgagatcattattgcagggccaagcgtatcaaaaggttacctgaacaatccagaaaaaacagcagctgcgttcttttgtcaaaatgacttagcaagttaccatacaggggatgcaggaaggttggatgaagacgggcttttattttatgaaggccgtatggatcagcaagtcaaattacatggttaccggatcgagttaggggatatcgaacattatctgttgcaagactcccggatcaaacaagccgttgtcgtaccaaaatatcaaggaacaaaagtgcagcagcttgttgctttcatcgtattagaaaacacaacgaaacaaccggattttcaactgaccaaatcgatcaaagaacaattactgcaagttgtgatggagtatatgattcctcagaagttccattatgtcgatttgctgcctcagacagtaaatggaaaaattgatcgaaaaaaattaacagctgaggtgaatcctgaatgatgtttcctcatatgatcccttacgcagagccgttttatttttttcttttagccattgcgcttataccaatcgttctatctttactgatatggaaaaaaagattaccaatttatcaatcagtggtgacacttttctttttatttgtcagctttggaggtacttattgggaacagggagcggcgctgattgggtatgttttttggcagacaatccttgtatggggctattttgttcaccggcaaaggaaaaatcaaacaggatggttttacgccgccgttattttagcaataattccactgtttttaacgaaagtgactcctttttttgaacatggaaaagcatcgctacttggttttttaggaatctcttatttaacctttaagtctgtgcaaatgatcatggaaataagagatggcatgatcaaagtatataatccatttcgttatatccagtttctgctgtttttcccgacaatatcttctggacccatcgatcgttataggagatttgaaaaggatcagctccatccacctgttcgtgataaatatgttgatctcttgggaaaaggcgtccaaaatatttttgtcggttttttatataagttcattatcggttattattttggtcaagtactgctccctgcagtagggcgcatcgcattacagcatggtgggatttcatgggcgttagtgggttacatgtacgtgtatagcatgtatttattttttgattttgcaggttacagtttgttcgcagtcggtacaagctacatgatggggtatcagacgccaatcaatttcaataaaccatttttatcatggaatatcaaagaattctggaatcgatggcatatgaccttgtctttttggttccgcgattacgtgtatatgcggttgatgttcttcatgatgaagaaaaaaatctttaaaagcaagatcgtgatgtcaaatatcgggtatttcgctttgtttcttctaatgggtgtctggcatggattgacgtggtactacatcgtatacggtctgtatcatgcttgtctgatctgtctgacagatgcatggatccgatttaagaagaagcataaagatcagttgccttctaacaaatttacgcatggcgtagccgtatttttgacatttcaagcggtatgtttcagcttcctgattttttcaggatttttagataaacttttttttagctaacgaatagtgacatattaatttatataacaaaggagaaaaggaaaatggaagaacaaattttatcaatcttagaagaaataacaggaacagatgaagtaagaaaaaatcgtgatattgatctatttgatgaaggtttgcttgattctttagcatctgtgcaattattagtcgagctagacggagagttggatatccaagtcccagtctctgaattcgagcgggaggattggcgcacaccgaataaaatcattcaacaagcaactgcattgaagggttgagtatgaaaaagaaactctttgctatttttggacctgttgttctcgcttttggtctgcttgccctattcttcacttcttcctatcgagtaaatattgataacccggaagtaatcaagcgagcgtcttcatctatgtcagcaaatgtactaaagggcgatgcaataaaaaacaaagctttgtctgaaaaacaatatatccccttttttgggtcgagtgaattaagcaggatcagtccatttcatccgtctgttttggctgaaaaatatgatagaggttatcgtcctttcttgctaggagcgccgggaacacaatcattaagtcaatatatgatgatgcgatctgcaggggatgatttgaaaaacaaaaaagtggtgtttatcatctcgcctcaatggtttgtaaaagatggtgtaaaaacagattatttcaacacttactattctgaacttcagacctatgattggttgttctcattgaaaaaagttacatcagctgatcgctatttagctagaagactattaactttttcaaaagtaaaagagaacgatacgctgacaggaattctacaaacgattaaagaaggaaagttacctttacctgattctttggatcagttgcacagccaatggaacatgttgaagcgtgaggatgagatattcagtgatatcggtttgaaagatcgtcagcaaaaaatcgatcatgaatcaaaacaattaccagaccactatcaagaaacagaattatccattttggcagatgagattggaaaacaagaaacgacaaataatccatttggtttgaaaaacgatttttatacacatcgtatccgatcccacgagccagaactcaaacagtcacaaaaaaattgggattatcgtttttcaccagaattttctgattttcagctaatcttggatcaattagcaaaaaaccataatgaagtgttgtttatcattccaccggtcaacgagaaatggagcgattataccggactatctcaagaaatgctacaaggatttgccaaaaaaatcaaatttcaattaaatagccaaggattcaatcgaatagctgattttgtcaatcaagctggtaccaattattttatggaagatacgatccatttagggtggaaaggctggctggccgcagatcaacagattagaccgtttttagaagaaaaccagcttcctagtaggtaccatctcgatgatgcttttttcagcaaagcttggcaacagcaagtaccagataaactacgattaaaataaataaaacaggtggaggatatctgcctgttttatttattttagaatattctgaaataaacagtaaaaataccaagtttgcctgaacaaaaaacaaaagcaatggtataatcacaatatgaatatagaaatgggggaaaacatttggatacaaaagaagaacagctactaattgatttgacttctgcaaaaggagtacctgggaatgaagaagaggtaagagaagtattcagagaatatgctaaaccattcgctgatgatattttttatgacggattaggcagtgtgattgctaagcatggcgctggcggaggaccaaaagtctttatttctggtcatatggacgaagttggttttatggtaacaaaaataaccgaaaaaggcttcttggagttccaaacacttggaggctggtggggacaagtgatgcttgctcaacaagtggaaatcaaaacacgagaaggaaaaatcattcacggggtaattggttcaaaaccaccgcatgttttaacacctcaggtacgaaataaaccatatgaaatcaaagatatgtttattgatatcggcgcatcaaaccaagaagaagccaaagagtggggcatacgtccgggagatatggtcaccccatatattgaatacaaacgaatgaatggcagtaaatatttactggcaaaagcatgggataatcggatagggacagctgtttctttgcgagtattggagaatctatctaaagaagcacatccaaatgttttatttgcaggaagcgatgtgcaagaagaagtgggcttgcgaggcgctcgaacaagcacgcaccttgtaaatccggatattgcttttgctttagatactggtacagcaggtgatactccaggaatgacaccaaaagaagcagattcgattttaggaaaaggtccacagattttgatttttgatgcatcgatgattccgcacaaaaaattattgaatttcgttatcgatgtagcagaggaaatggctatcccattccaatatacagtgatctctggcggtggaacggatgcaggacaaatgcatttgacaagagacggtgttccttctgtagccattactgttcctgttcgttatttgcattcccacacatcagtgatccatgaagatgattatttgaatacagtgaagctagttactgagttagtgaaacggcttgatagtgaaacagttgaacaaatccggagttatgaataatgaataataaaatgcctatttctgaatatcgaaaaaaagcgcgagcttctttagagaatcaatggggaatcaatgcttggcttgttttcttatccatattgttcacaagcgtcatacagaatttttttgacggtttcagtccttttacggaagaaagcatgcagcaaaacctattgagttttctagtcaataatttgcttttattcgcattcaactatgcattgttttatattgcgttagtagttgtacgaggtggcagaccaaaaagcaatcttctattttcagttttccaaaaaaaatattttggttcgatacttgtcatcaatttgattaattcaatcatcaactggttgctcaatagtttgatctttctgcccatgtttttaatcagcggagtgagtgcttatacgcagttgcttttcaattcaagtacggtacctacggatgtcatgccaggagattttcttgatatcagctttgttttatcaatggtagggatgatttttgtttcagcacttatcatgagcatcgttggcggattgttccaatttgctgcatggacgaagttcgactatcctgatttgtcggtcgtacaatgcttaaaatatggctggttcttattgaaagatagaatcggtacgtatattttgttgcaactatcttttatcggctggtatttgttaggggcaatcgctttattcatcggtcttttgtgggtcatcgtttatgtgaatgtatcagttgcagaattttatgaacaagcacggattgaaaaaggtggtccagaagcctattttgcttaatctgtaagcagttcattcattagaaaaataacttttgtggtaggataaatctttgagggggaatgtatgatgaaattaactgttttaggctgcttaggggcgtatccttataataatcaagggacaacaggttatttacttcaatctgacggtttcaacttgttgattgatgcaggtagtgctacgctgatcaaattacaagaacatcttgatccacttgatttggatgctgtgatccttagccattatcatcatgatcatattgctgaccttggtgtattacagtattactggcaacttcatcccaagagagatccggagacattgctttcaatttacgggcacacaaaagattctgtccactttgaagaattgacgatggcgaatgtctcaaaaggacatccttattttgaagccgaagaattaaaaattggtccttttctgattacttttatggaaacaatccatccagtagtatgttacgccatgcgaatcgtagaagaagcaacggggaaagtattcgtatttacaggagattcaggttatttggaaagtttcgctgattttgcgaaagaggctgatttgtttctagcagatacctatctatttgaaggaaatgaacatcatcatgcacatttcacttcaaaagaagctggagaactggcgaaatcagctaacgtaaagaaacttgtacttacccatctacctcagtttggcgacttagaacaattgaaaaatgaagcgcaaaaagcagcaggtaaagggatagatgtagaacttgctgcagttgacaaagtgtttgacatttaggaggaagaacatgatttttgtaccaaatgaaaaccacgacccaagaatcaatttagcaattgaacaatacttgttgcaagaaatgccattagatgaacccattttgctcttttatatcaatgaaccttcaatcatcatcggtaggaatcagaacacgattgaagaaatcaatcgagattatgtggaagaacatggtattcatgtggtccgccgtctaagcggaggcggagctgtctaccatgattttgggaatttgaactttagttttattatgcctgatgatggtgattccttccgtgattttgcgaaagtaacacaaccaatcatccaagcacttcatgaattgggtgttgccggggctgagttgaaaggccgaaatgatttagtcattgatggtatgaaattttccggtaatgcgatgtatgctaccaatggccgaatgtttgctcatggaacgatcatgttcgactctgatatcaatgaagtagtcaatgcattaaaagtaaaaaaagacaaaatcgaatcaaaaggaatcaaatcgatccgttctcgtgtgacgaatatcaaaccgtttcttcccgaagaaaaacaaaaaatgacaacggaagaatttcgtcaagaaatcttgttgaaaatttttggtgtagaatcagtagaggaagtaaaaacgtacgaattgaccgacgaagattggaaaaaaatcaatcgaatctctgaagaatattaccgaaattgggattggaattacggaaagtccccagatttcaatttctctcgtcaaaaacgtttctctatcggttcgatcgaagtccacttgaatgtatcagaaggaatgattaaagaagcaaaaatctttggtgatttcttcggactaggagatatctctgatgtcgaaaaaaaattggtgggacagaaatatgataaagaatctctatcaaaaatagttgaccaaattgatgtgaaaaaatattttggtgcgatagaatcagaagaattgcttaccttactttattaaaaacaaaaagcagcggaatccttatgtattggatcccactgcttttttatatagaattcgagtaatttcgggaaagctgaacagtgattcgatcaatcaatgtatctttttcctgcgttagtgttccagtgtaacgatctgccacatctttcatcatcatcaaatcaaagcgttcctgatcatctaattcttctgtgatacctcgactgaatatattcgtatcataatgtgcactatgttcgcaacaaatgatgaaatgatcctcttgttcgtgtatcgacaaatgaatttttcgatacagcggattttcgatggcatgagtttctctaaaggaatgctctagggcatgaatcaaaagctgggctagatcatcatctttgataggaagatcctcaggaagttctgcttggaaggtgatctggatattccgtttagcagctaactgttgatagcgcgcgaaaatcagatttgtcatctgatgattgcaaaaagaacacagcatttcaaaattttttgcttcttccaagattgtttccacatatttttttgcttttacttgatccgtatgcattaagtcttgcagattttccatttcctgaacaaattctaaacgaagcgtatttacttcttggatatgctgtcgaagttgctcataatgctgttccagcaaatcgtttttgatttttaagaaatctacttgtcttcggtctttatctgtgttcagaatgtggtcaatcagattgtaactgataataacaatcaaaataataatgaataaaatcgtagaccaattgatcgtcgtttgataaatacctagtgctgtttggatataaatcaagcagtggataatggcaaccaagacgatccaaggtgtacaaactacataaaaacgattgtttttatatgcttcaccaatgcaggtaagcgaagtgactagagtactgataacactagctatattagcaattggcatcaattcaggaagttctgcagaagtaaaagctgcataaagcagaacaccagaaaagatcgaaagctggattatacaaaaaatcccataccattttttataataaatcatccggctccaataatagcagataatgaaagccgaggttaggataataaataaatgagataaaaaagagtgaacgaatggttcaaaaaggatgccacttaaaatatcttctgaaacagcttcaaatcctaatgccaaagcaaagcagcttaagataatcagcgagtattcaagccgtttttgtttgtacatcaagtagatggtatagataaacgtcccaatagcaatgaaaactgcaatgatcatcgttaatacttgcggtactgattgagaatagataaaaccgattaacggaccagttgtacctatatagactttcggtggcaacccagcgtagttttgataaggagatgagacagagatcatcaatttttttccgatgtaatctgatggtaaatctatcacagccagtgataatccagggttgctttctgcgtcgtaatcttcccgttggtataaaatgtttccgtttagatacacagtaatccattgatgatttcctttgattagtaaatttgcttcgttcaacggtttctcaagtgtcgtttccataataaatgtttcatctttgtctacggtaggaatcgtacgagtgtacttgctgtcaaacttaaaatcaggatcatcttttgaatagaaaacccatgaatcttttatttctttcatttgattactattagcaggagagaagataaaatagaagaaataagcaatccctgctaaaaataacactgataatataattattatgctccattttatgcgcatatagaaagattcttttttattatatatgttattaaaaaaagccataaaggtattcctttctaaaacttgtaattttagggtaaacgttttttttactaacgtcaattatttataatgaaaaatgagataaatatgaggaaatagaatcaaaaaacgtcgttgtcataaaaatgtgtttttacagttataatttgaaaaaaatttatcgttattatatgattaagaaggattgaagaaagaaaggagttgaaaacgatgcctgattacaaaaaaataacttttgttagttctgtaacgctgattatatttttaatacttattcttctcgtcgtcttggttccccgaatttttggattgactccttatattattgaggatagagaaatgaacccatattatgcacaaggaaatctgatatatgtacgaccaaaaaatacagatgagattttagtcggagatattattacatattatgaaaattcaggtaaaaaaatctcgacacgtcgcgtaatagccattgaaaacaactacaacgacttttatacaaaagctgacacacggacttatatcgagcctggagtagtaaaaaagagaaatattatcggtagtccaatcttccagattccatatattggtctggtcctttccaaaacagcatttgcatggatccaggggttattctttacgattgctttttgcttaacaggaatcacagcttggaatacttttgtagagttgaagaagaagcggagacgaacacagaaatttttgtgagaatgttgaaaaagacaaatatattcaagagataccattactcttctgaacgagtgatacggaaaatactcatacagcttgtagatttagctagttgttcgtataatgtgtaaagaggaggagtagtatgcgcaatgaaatgatgcatcgtcctgtagtcaaagaagaactattggactttatgcgtacccagcaaaaaaaattaccgggtgagctaggcaaattggaagaagaagctcatgtagcagaagtaccggttattccccacgaaacagttgtatttttgaaatttttacttggacagattcagcctgaacgaatcttagagatcggtgcagctatcggtttttcatcaagtgtcatggcgacaacaatcggagaaaatgctcatgttacgaccattgatcgtttcgatgtcatgatcgagaaagcgaaaaaaaactatgaacgtctaggattgacagataaagtaaccttgcttgaagggcaagccgcagatattttgcctgaattgtctggtccatatgactttatttttatggatagtgcaaaatcaaaatatattgaatttttacctgaatgtttgcgtttgttacgaaaaggtggcgttttgatggtagatgatattttccaaggagggacgatcttgctccctgatgaagagattcctcgtggcaaacgagctatccatcgtaaattaaatgaattccttcgtgtcgtgatgaaccatcctgatttgacatcgaccatcttaccattaggcgatggtgtaatcttaatgacaaaagaagcagaagaaatcgattggtgatacatgattatgacaatcagtaagtgattgattatatcaaagaatccatctaaatttgatgtgaaagagactgtatttgtaaaacaactgaaggaaatagtgaatagattgaaataaacaggagtaagcatgaagacaatgcaactcctgttttcgactgataaccttagaatagatggaagcgaatgtttcttttcaaaggattgatttggtagttgaattaaaataattggctatttgctaattaaataactatttcgtattgacagaagcaatataattatctataattattgatgttccgctgattcctgtcatagtagctcagctggatagagcatccgccttctaagcggacggtcgggggttcgaatccctcctgtgacgctaaaaaaccgttagaaactgaggtttctaacggtttttctttgttttttgtgccaatattgtttgttttcaaaggcaaataaaatgaaaaaaacatctttatctagtacaattataggaagtaaaaataaaatccatcagaaagaggaagcaaatatgtcaatattatcaaaaattttagtcactctagtggccatcgaatttttttatatcatgtacatcgaaacagtaagaactgattccgatactacaagcagagtttttaaaatgaataaagaagaattaagcagaaaatctgttcaaacattatttaagaatcaaggagtatacaatggactattaggggttggactactttacggagcttacctttcttccgcacctaaagaaattacaagtatgctgttgctatcaatttttattgttgcattgtatggaagtctgactagcgatcgctggattttactaaaacaaggtgggttagctctgttggccttgctttctattttcttctaaatgtggaaaaacaaggatctattggacaggaaactttgtgaaaaatattactttttctcatgaaatatgctattctaatgaatggtattttagaaaatttcatgaaaaggagttagataggtgttcaaaaattatgttttatcactaaaaaaagaatttttaggttatgatctttcaagatttcagaaagatcttttggctggaatcacagtagctgctgtagcattgcctttagccttggcttttggggtatcaagcggagccgatgcgtccgcaggtttgattacggctatcattgccggtctcgttattggcggtttatcaggcggtttttatcaaatatcaggtccgacaggcgcaatggcagctattctaatgtccattgcggcaacaaagggaatgcaaggtgtgttgcttgctacttttttggcaggtctatttttacttgcagcaggacttttccgattaggaacactaacttcttttatcccagcaccagtaatcacaggatttacttcaggtattgctattattattgcattaggtcagatcgataatttgtttggtgttcattcggaaggtacaaatgttattgaaaagctaagtagttatcaaacactaggttttccaataaacatagcatctttgattatgggaggcctagtcattttagggatgttcatctatccgaaaaaatgggcgaaacgaatgcctagttcgctgttggccatcattttagcaacagtagttacgctactgtgtcatttaccagtagccactgttggtaacatcccacaaacactgatcagcagtaatcgcttgggcttgggagattttagcttttctgccttgcaacaagtagccgttccggccattagcattgctctgttagggatgattgagagcttattatgtggtgcttctgctggtcgaatggcgaataaatcattagacagtaaccaagaattagtggcacaaggggtgggaaatctattgcttcctttttttggcgggattcctgctactgcagccattgctcgtacaagtgtggccatcaaatctggcgcacaaaccagattagctggcatgatccatgcagttgtcttgttgctttccatgcttgtttttgcgccagtgatgtcacagattccgatgccggcacttgcaggtgttttgatcgtgacggcttggcgtatgaatgaatggagaacgattaaggagctatttgttcataaatattggtcagctattctattgtttgttcttacaatgatttgtacagtcatctttgatttaagtattgctattgtaattgggattatcggcggttgtgtattttttgttgtaaaaagtgcggctatcacgatttcattagaaacaatcgattggcaaagaatggggctgccagaaacggaaaagctgaataattggacagtagtgtacatcagcggtccgctgtttttcatgtcttcagagaaactaaaaaataaattggaagaactaaaccatcacgacggtgtcatcttctccatgcgtggcgtaccaagtattgatttgacggcacgcgcagtttttgatgaatttcaagaaaaagcagaacagagaggacaaacgattatctatacttccttgcagccggaagtagaaaaacaactttctcacttatgggaatatacatccacacatcaacatcaaacagttgctcatgcgttgacagcattgcatgcgaaatatactgcaatgagccattaaaacaatgaaaaagaatagacaagactgtaaactaacaatttcaccgtcttgtctgttctttttaatcttgttgtaaaagtgaagctagtacttgccaatcttgatggataacaggtacaagggaacgattataaaaaatagctgctggatgaaaaagtggaaggatacgatagtttttttctgaccattcgtaggcatctttttgttttgttagctgtaagacgggacctgtatagagttgaccatggtttttggtaacagtatattctttaccaagtaatcgttgcaggccaatatttccaagtgtcgcaattaattttggctggatttccatcagttcgtaatccagtatcggtgcgtgtgcaaatacttcggatcgcgtaggtgtacgatttggataaactgtttctgtctgttgtgtccgtttattgatccgatgagtcacgcgatacgggcgactccgtacagcactggtgatatagacatcttctcgtgttaaaccagtggaagaaagtgcctgcatcaattcttttccagcttgtccgctaaaagggatgtgtgtatcaatctctgttttccctggggcttctcctacaagcattaatttaggatgaagaggtccttgcccagcgacaaacccttctacaggacggtcgttcatccttaaagaagcctcttgtatcaattctgttgggtattccatttgtgctcctcctttttcttttattataagaagaaaagaaacgcaatgcgactattttatttggcagaaacgaagaggaaagaaaagcaggagaacgattgtttaaatctttatttcattttttgactttaaatttagttgacgaacagcggctgttctggtaagctagtactgttgtaattgtggactccacagctacaaccgctcagaacaagtaataagcacagcagatgctgtcacttcggatggcgagtctaagtatatcagaaggaggtgctttatagcatgtacgcaattattaaaactggtggtaaacaagtaaaagttgaagttggacaagcaatctatgttgaaaaacttgacgttgaagcaggagaaaaagttgtttttgacgaagttatcttagtaggtggcgaatctacaaaagtaggcgctccaactgttgcaggtgcaactgttgaaggtactgttgaaaaacacggcaaacaaaagaaagtcgttactttcaaatacaaacctaaaaaacattcacaccgcaaacaaggtcatcgtcaaccatatacaaaagtggttatcgacgcgatcaacgcttaatcagcgtttgagaaagaaggcctatatatgatcaaaggaacatttaagcgaaatgacgcaggtcagatcgtttcattcactttgaccgggcatgctgatgctggtccttatggaagtgatatcgtttgtgcaggtgtttctgcgttagcgatcagcactgtcaacgggattgcctcattagccggttttgaaccgattgttgaaatgaatgaagaagaaggcggttatctttataccgaagtcacttcaggaatgacacaagaacaaaacaatattgctgagattctattagaaaatcttttattaggtttacaatcaatagaagctgaaaactcagaatatatccaaattaaaacaatcaatgataaataggaggtgcagaccatgttgttatctatgaatctacaattatttgcccacaaaaaaggtggcggttctacatctaacggccgtgactcagaatcaaaacgtctaggtgctaaacgcgctgatggacaaacagttacaggtggatcaattctttaccgtcaacgcggtacaaaaatctatccaggtgtaaacgtgggtatcggtggagacgacactttatttgcaaaagttgatggcgtagtacgtttcgaacgtaaaggccgtaacaaaaaacaagtgtctgtttatccagtagctcaagaagcttaataaataaactgctctatctcttgtgtggcaagggatggagcttttttgtaaattatgggattttttttgaccatacttttgaccatactttcttagaagttaatataatttgttagtttttgtgttgtttcttcttttttgctgttagtaatgtgtgtatatgtgtccatagtagtttttatatttgcgtggcccattctttcttggacttctttgtgatctgcgcctgcctcatatagcattgatgcatgtgtatgtctaaaaccatgcagaccgatataaggtaagccggcacgctcacgatatatattgtatctttctgccactgactgattaattgtgaaattattttcgtcattggtaaacaaataattagctttagtaaatcctaattgaaataagtactttctttgttcgagcttccaaaattttagttgctttatagttttttcatctaaataaattattcgatttgattttttggttttaggagtttcagatatataatatttatctgaacgagctacagtttttttaatggccatttcatttgttttaaaattaatattgtcccaagtgagtgctaatatttcgccgattctacatccgctgaatgctaatagtctaaagagcgtatagtctctgtttttaaaatatggattctgttcttgagatacttcatttagaaataattccaactgttcttttgtatataattttaatttcttttctgttttaatttgtggctttggaataagtaaatttaatgttggattatcagatgttaaaccaatatttatagcatacttaaaaactttgttcatatagtttatgaaaagagggtactgctttgaagttcctttttcactccaatcatttactaccttttgacaatatgccgtattaattttagaaagcttaatatttccaaatttgggatatatatgtttgttaaagattattttagtccttgaatatgaactttcttttacagtttttttatagctttctagccataattctgctgcttctttgaaagtagtatttgtacttgtgggcattcctgttttttgtaattctagttctaacctagaaagtgctgtttttgcttctttttgtgttctaaatcctcttttagtagtatattttttctttcctgttagcggatcaataccgagataagttttaaagtaccatgctttttcgccatttttctttttatattgttttatcattgccatcaatattacccctattcaaattctaattctgccatgctatcattgaaaaattcgatcagtccttgttcctctataaattcaagccatatttccttcccgttaattaatggaactcctttttctttacgaattgtttgatacaagttagtcacgacttgtttccacatttctaatacagctttatctattttcttatcatcccagcgttttttttggggtctatttttgtttttttcaatttgataattagtagctttgatgataaatgtttcgtatccggttgtgtttttttctaaccattctttgaattctgtatatatcatttttgttcacctttctatttttgaacgtatgttctttttttgcttaaaaaattttagagggctgcataacaatagatgcgagcttttaataattctttcacaagtggttcgaagcgaacgcttaaattattatcttctataaatttcatgtaattgatattgtgtggttctaattcagactttgcaatatatctatctaataatttttcaatcatgaagcgatcagcctcatattccatttttgaatgtagagagaatgctaagttatataaaaaataattatcatgatgtttagaagcgtgtcctaattcatgtaataaggttcttcgtcttctatacttagataaattagcttttattactatggtattcatacaagcaacataatggccatcggcatcaaggttttcacgctcttctaccttgacacctagctcattaagcatcatttcaatttgactgtccaaccgactcacctacttatattttttttcaatatacgcttctattaattcggtaagtatctgcctatcattatcggtgagtggttttccgtcactgctcattacagatgctaaagcttcttcaacagttagttttcttttctctgatgcaacacttatgttgggatcatctgtgcgacctagtaagtaatctgttgaaacatggaaatagtcagcaacttttattaaattagttcctttgggtatattctttttccaagaataaagtgaatttttaccaatttctagcttttcttctaaatcatttactgaaatgccttgactatcacaaagtgatttaagcctgtcaaaagctgtcatatcaagtttcctccgtttcgctaacgaagagcattaaaactagaactaaaaaatgctttttttggcttgacaattaaaactagttttaatatactgtattcgtaagctaatttaataagctaacaagcaataagaaagacaccttataaaataaacaaattcgaggtcggcaaacttagaatgctaatttacaaggtaattctgtgcttatttaactgtgatttaattttaaatctagttttaaaaaaagtcaacaaaaattagctaattttattagcttacaaataattaaatgaactatatcaaagaaaggaatgaacaaaaatgaatacaccgcaaatttttaactttgaacaacatgaagtaagaacagtaacaatacatgatgaaccattttttgttggaaaagatgtggctaaagttctagggtaccaaaatggtagtagagatattaacagacacgtcgatgtagaagatcggcaaaactaccaaaacggtacttttgaatcgcctagagggttaacaattattaacgaatcaggtttgtactccttaattttaggaagcaaacaaccaaatgctaagaaatttaaacgttgggtgactagcgaagtgttgccagcaattagaaaacatggaggttatctaactccagaaaaagtagaagaagctttgcttaatccagatacaatcattcaattagcaactaaattgaaagaagaacgtactggaagattaattgcagaacaaaagattgcagaatacgaacccaaaatctcatatttagatagcatattatcttctacagattcagtaacaattagtcagattgcagcagattatgggatgtctccacaacagatgaacaaactacttcataaactaggtattcagaaaaaagtaggcaaccaatggttattatgcaagaaacatatgagacaaggatatacaaaatctcatacaactgagattccgaaatctgatggtggaacaaaagttgtgatgaatactaaatggactcaaaaaggacgtctatttatctacgaattactaaaaaaagaaggatatcttccagaaattgatctattagaggagagatagttatgtcgcaggacttcattttaaaagtgcgtgtggcgctagctacgcataataagaaccaagcttggttagctaaaaagattgatatttcaacagcttatatgtcggatattatgaacggacatagaaaaccagataaacaaatcaagccaattgaggcagtactagcagaattagaaaaggagaaaaaacatgcaaataacaattccagataatttagtagtttccgaattaactacacagatcacgaatgcagtgcttaattctttggaagaacgattacaccttatgaataaatcagtggagcttcctccatatccaaacaaatcagaggtaaaaaaagttttaggcattggtgatgacaaattaacacattggataaacctaggcttaaaaacacagcagtggagcaagttagacatcagaattgaacgatcagaactccaaagatttttgaaagaaaactttgagttctaaaggcaaaggagaatgattttatgtcctacacattgcaacaagaacatcaaattctccgtttgattaaacaacgcaggaaacaattacaagatgatcgtgaagcgcttagaaaagccgatgagctatcagatagacaagctgaactaatcgcttctgaacttgaggatttgagaatgctagaaataaaaaatagggagattagattatgaagaagacagacacactttttataggattcattttggggttattagtgattgtagcgcaccaaagtattatcgggggaagcttgttcgcagcattgatggttttaatcaatctgcttgattcaaaagaaaggagcaactatggcacgagaagaagcgctaaaaatcggtaaagtgattgctgataattggtgggcaaatagccgtcctattattttaagtaagcaacatatcgaaaagcaaaaagcatggcaacaaataaaaaagtgactccgccaacaagcatagagtcacaaagaaaatacatctaaggagattttaacatatggaaaatgaactttccactctagatcaatatttgactgatcctagttggggcaaatcgaatgtcaaggaaacaaataatcgaaaaatcagacgtaatcttttgacagatgaagaactagcatgtgatcaagatgatttgggcaattttgttagcatttgggatcatgtttaccttattcatctatcaaaacattcaaacaaacctgaatacatttatgtcatcgaagatggcttgactgatgcattagaagagtatgacagagataacttgattgatatctcttattacggaccaggtaagaaatacattgctgaaatggaggcagaatttaccaacatgtttagacattttcctctaggaaaaaattaactagcaccacgggttaaattagcttcttttgcgttaactcagataatactattcatttttaattaaaaaatataaggcatagacatggcaccataaccaatatcatattttctcaactctttagcactcaattttgtgtaatcttctttgataaattccattaagcacttaatttcattgatatttatgcgttcctcagcttttaatttagataaatgtttgtacactgatataataatttcaggatatggtttatcctctcgtattttcttagcatcttgaagaaatccttcttttacttctacattattatatgactttgaattatatgcattcgcaattaagtcaaaaagtttttcttttttatcttccaccgactccacctagcactttcgtaaaaccattaacgtaagcttttactcctctatcaacaatctcagagcgagctctactccaatctacccaacatttttgagtattacaataaacaccatttccataataagttgcagcatctactgtaattcctaaagtagatacactcaataaaacaattcctaaaatcaaaaaatactaacaaattttttcttcatataattgcctcccttttttataaaacaattatatgtaattttcagaacatttttgcaaaattttcataaatagtatctttagtgtcatgatcgtcaccaatattctgtaagatcaatcaaattttatctcactaataataatagtcttaataaataaaaaatggtcttcacttttcggaatatttattataaaaggagcttgctataaaaaagagaaaaattaaaacacaataaaacatgtacaagcatatcaaaaaaggccagtcaacaaacctgttaactagccttttttttcttaatttctaaataaacgatacagccatttttgcggacgtctacgatagatcacgtgcgtttctactgcttctgtccgttgctgctcatgataattgaaaatctcatcttcagtaagatcatagtccatcatcaattgctgggctttggctaatgcgctcattgattcctcatcatttacatccgccgcaagcgccagtaatttttgaatcttttcttttctcttgtctgccattttctactcctaaaggtaagtgtgtgttaagtctacttcttttttctgaaccctactttccagtgttgctagttctttttgtgcttttttcgttcgttttagtccttctttatacaccgttgaagtcttattatgacctaacaattccaactgttctaagtcttcctctaatttctctacccacattcgcttatggtctaataaattgtatttcatggtgatcttcctttcttcctttacttgcactagcactctgtctataaagccagttcccatgccaggtttttatcctcatagaattttggatcgatatatcgggttaacttatcgcattcaagcgtaaagctttcttcctcgaatacaatagagatattgtccaatacagttccttcaaaggctagcgcacctaattctgtatgattgtttacccaaacgactttttcttcagtaattctaattccaaagtaatcacgtaccccatcgtagccacaaaggcaaatgacctttgcttggtcaaaaaagtaaggcattttaaagtaacgatcatctactaccgaaatttcagatcgttcaaattctacaacaccatcttcagttgcggttaactgtgttaaaatatctgctaacgatagtttagtttgttttttcttcatcttatttccaccttttccattgtctaaaagtgatatcacttttaggttttagtataaaaagtgacgtcactttcttagtgctggtacctcaaatcctgctttttcttggcaatcaataaatctaacgcaatacacataatcctggattcacttttgccgtacttctgctttagttgctgcaattctttttgtctcttttcatctaatgtcacgggtaaccgtttatttcctattgcaattggcattggtactctctcctttcatcgaaataaccccatgaaaaatatggctgcaatcatcttgaatagtagactcacgaggactaatacaaaccgccaaaagatcaaacaaaacaccagtattaccaaaaatacagcgaggtttaactgtacagctgcactatctcgcataagtatttcgccaacaaacagtactaacaataagggaataatcttgttcaaatggatcaccttctttctcttaagttatcgggctttgcccgtttatttcgcaccacctaagcggcgggggcggttggtgcgaaataagaaccattcccttagttactaggctttttttgtccttattccacacattctcacttttcggtataaatgattattgacctttttttctttcaaatcgttgatatggaatccgttgttagttgataaatcaccttattcattttcgttgtcttcctttttcatggtgtaatatgcgccatacttattgatattttcaaaataatctaaccattcacttgaaacagtcttggcttttttcgtttcgataaatttcgcatacgttagttctaaagcctggtattcagaaggtttaatagtgcttggtttgacacctatttccaagcatagtaaggcttggaaaaaccattttgcattttgctttttcagttcttccagtgttcgatagtacgtcgcaataagattcatttcgacacctgattcaatcatttcttccacagctaccgacaatttttctttataatgtttttttggaacacgtgtttcgttgtataggaacgtcatatcctccattttttgtgccattttatccaaaggtaatttgacaaattcgtcatagtaattttgagccatatttttttctcctttttagttctctaatttggttaaccaatattcgttttcataagtttccaagttttcttgataatgcagttcacatcctgcaatcttcactaggtcttgaaatagcatagtcggtgcatcctctactaaaggggtttctatcgtccagtaccgcggaataaataaagcttctgctactttttcagaaatgacttctttgtccaccaaaatttgaacgacttcttttacagtcaataatttgtgttgtgttttcaacagcgtttctttcctttctcctcaatcaaaatataatcgccataagacaaggtatattttttcccgcatgttggacattgatacaaacaatagcttttgatacatttcgctctttctccacaatcgcattcgacagtatgtggtgcatgatagtttgggaataattcgctgaagggaacaccccaataatcaaatttctttcgcatgattgattctgcctcctcttaggaaaggttttacttcctttcgttagttctttctttattgatttgctagaccggcaacaagttgccttttatcaccaaaaagcgacaaggacaagggtaaatggcacgctgcgcgcccttgtccttgtcgcttttcgttgattcattctggccaacaaatcaataaagagatagcgaacaggaacgaaccttttggtgagaggaggttttttctattttgtcttgctttgcaagaccccttatcttagtgaacgtgcaacgttcacttcctttcttctcgaacggcggtggcggttggagtgagagagaggtttttcaattgagaaggcgcttgcgccttcctaaaaaggccttttcatttttcttgtttctatgtaaaacaaaaagagctgcaatcctcatttaggactgcagctcttcttttatatgcccatcgatcgcgtaaaatgatcagggtttctaatttgcattgattcaatgactagttgatttcgtttattgaattgacctgtcactgaaatagtatacttgccttcttccaaaatcagcaatttatccgctatttctatattggccactacacaattgattggttcatgactcgtgcgtaatgtaaatcgcacaagcaatggctgtgtcttgatcaccctaattttatcgagtaaaccaatatattgttccatcacgatcacctcgctaaaattatagcaaaaacagctaaaattgagaatttttattcgattttagatatgctataatagtcaagacagtaaagtttgaagacggtggcgacttctggaaaggtggtggtgcttatgaatgtaagtgctaaaatctatgaaaggagtaagccttttgtccgcatatgagacaattcaaaccattcttggttttggtatgtttaccattgctttgattagtttgattgtaaatatgcttaaaaatgacaaaaagaaataaccgtctactttagcaggtcagcggttatttccaaataactaatattctgccaccgttctttaatcggtgctgttaatgagggggtgttagcgcaactcctctttttcatgttcattatagcaatatttcgcaagaagttcaacgatttcccgttaactctacatataaagcggtagaatagccgtaagtataacagctgtcgctgctactgtgactttagtcaatcgccaaaaggaattatcctttcctgctctttttaaaagataagaacagacaagatacacgaatacaagaaatagtgatcctttcgcaattctatttaccaaaggattttcagtgacgcccaaagaaatcccgtctataaatgcaattacgggtatcaatagatccatcgtcagactaattttttttgccatgcttactccttctttctcaaactaaaacggtagatcatcatcgctaatatcgattgattgtccaccaaatggattctgtgaagcgttcaatccattgttgttaggcgtcgctgtatccgttgttcaaaggtggcggtgcttggactggtggacgattgatcagcgtgcgcacggctctctgtcgctgctttattttctaatagttgaaagttatctgctacaacttcagtcacatatacacgttgtccttgctggttgtcgtaagtccgcgtttgaatccgcccaactacaccaatcaagctaccttttttagctaatgtcgccattgtttctgctggtttgcgccaaatcacgcagttaataaaatcggcttctcgattgccgttttgattcgtgaaatttcgtttgacggctagggtaaaagtcgctactgcagtaccacttgcggtaaggatctttggttaagcgtcctactaatgtcacattattaatcatctttatctctccatttctctattcatctgttggtgtctttgataagctagttttcgctctttttcttcgacgtgaatcactttttccatcaaattactaatcgaatccattgtctcatcgtacgtgatcgacgcagcataaggattgcttttttgatatttcttccaggtatcttttagctcgtgactatttttcagtacatccatatccttttcatagtatatctttaacggatcagtctttcctcgacgtgtaaatgtatttctcacactatctttcaaggtcttctcatcgatcttctccattttaggaatagtatagagatcataaaaatcttttcctctcgaattatctgttaaaaaatcaaaggttgcacttaatttttcagcaataatttgttctgtaggataggattccaaaggaatcgttcgatcctcaaacatcaatttatgactgtgagtgatcgttgcaggatagatcgagtcacctgtagtcacatctaccttaaaatctggccgcatgttttccaaatgtgccagcacacgtaagctaaatcctggatagtaatcggcttctctcgtttctttcattccttgaatctcaaattgaatgccttctttcgtcggcgttgaaaaaatttcgtttagaaccgttgttaatgtttctttggttactttcatttcccgtaaagtcgtatcaatatctttggttgtgcgattttcaatgccgtactttgagccaatcaagaagccgccttttaacacaaaattttcacgataaggagactctgagattttttccaagaatttttccatcataaaatgtcttaaaacaagctgcggatcaacttctttttctctagaaatattcttcacttttgcttttaactgcgtaggtgtcatgtatcttctcctttaatttaaagccataatataagaacgcatcgttttgtctgttggtaaaattcgtcgatactcattcaattttctaagattttttctgtccgactccatatagtttttgattgcttttactttgatttcatcctcaacggtataccagggattccaaatgtcacataaagttctttctggatcataagctataataggattcccatagcgactttttatttcaatcttacctaattcataccattccgcttttgtatagtgtagctcaactgcgaattccttcaatcctttttcagaaacgtgataaccataaggtacagtcagatcgatctgtctagggatcatatctgttaaatcatacaaatctaacgcggtaatatgtgaaataatgccgcgttcatattttttttgcgccataaacaattcatcaggaaattgaccaggtaaggtgaaaaaacctggatactctcgatccagctcccctcgatctaccatacgtttgatcgttacaggagaaatgcccgcttttttggcatccttcaaagccaaagttccattaaattcttctagcagcttgtataccattgcttttgtcattttctccctcctttgtatacgtataaacttataaaaacagtataacataagtttatacgtatacaatagttaggaagattttatcgatctaattcgatttctttttgaatcctctgctggttcttcaattgctgcaatcttcgtctgttggcacgtaatttctcttgttctgaacgaattttggcttttttgattttcgatttcttgttgtttgtgtgttgtatttcgcataagataaaccctccattattttgtagtgcatcgtgttcttttcttaaagttcgtttttttcttttcagaaaattcaaagcccgttgtaaagtcttcttttaaaacaatcgttgcttcaaacgaacctttttgtccttttaaccctttcactggctggcttgttcggctattttgaataatctccttcagctgtgtcgctgtgagtttctttttggcaatcgttgtccataatttaaaatcacaggcttcagacgtgcatgccgccactttctgataaagtaagacttcttgttcctggcattttggacaaatccctaaatgacgtgcggcttcttgcttttcactggctgctttcacctcttgtaacgtcgatccaaaatcagtggtttggatttgccctggtacgacttccaataaatgagagacaaatttttggatattggctagaaaagtggtttgtgttccttttcgttcaccgatctttaacaagtagctttcccatttagcggtcatttcggcgctcgtaagcagcggctctttttccacggcttggcaaagcaaaatccctttattcgtcacaacgagcttatttttctctaccttgatatattccttttgtttcaagatttcaataatattcgcccgtgtcgcttctgtaccgattccttctacttctttcaatatggattgcgcttcttcactatccacggttttcccagctgttttcatcgcagtgatcaacgtaccttcggtataaggttgtggtggcttggtttctttttcaaggacttgtagatctaccgtcaccgtttctccttttgtcactttaggaagtagcggttcctcttccttttcttttctgtcgctctctttgccaaacagctttttccaacctagatctagcggcacctttccgattgcctttaactgaagctgctgaacttgcgtcaagatcgttgtttcttcataggtatatttttccgcaaacatggccaccgttgtttttaacacttgttcataaatggcctgctgcagtggacttaattgttcaaaagccgctgccgtcatgaccgtttttgtaggaatgatcgcgtaatgttcctggactttcttattattcacatatcgactattcggtgtatgaataggagtaggaatggcttcggcctttaaaaagtttttgtattcgtctaagtgatccaacagatacgcatactccccttctgtaatataaggggtatctgttcgtgggtagcttagatatttcccttcatacaacccttgtatggcttccaaagtatctttggcactagctttcatgagctgattcattttagactgaaggctggatagagaaaaaagacgtggacttgccgcactttttttctcggtttcaacttggtggatcgtacctggctgttttcccaattgaacccccttttcttttaaataatcttcaaatgcttcttgcgtcgcttgggtttcattcggatcaagcttcgcatcaaatgcgccattttgagcgattacttgggcttttccttcaaaataaggctctttttggaagtttctaatcttttcctgcagctgataaatcatgtaaagcgttggggtttggactctgcctaaggaaaaacttcctggtatgcctttttgctgcaagagtaaactatacagtgggctgccgttcatgccgatcaaccaatcagcgatctggcgtgcttgtgcttcttcaaatttgggataggtctcttctgcgtctcgtaattgctggaatccctgataaatggcttctttttctaaggagttgatccaaagtcttttaaatatctttccatgatcggcgcctgcttgttgaatgatcgtccaagctatcagttccccttcacgatcgctatctgtcgcaataataatggtgtcggccgattgaagttgctgtttcaccaccttgaattgctttttcttatctttaggaacatgatagtgataatgtgtagggaaaataggcaaatgctctaatgaccattgtttccaattttcatcgtacatatcgggcgaatctaactcgactaaatgaccaaaaccatacgtgatcacagtttcaccaggaaacaatctatcttggatttcaaaatacccgtcttttcgggtggctttagagaagctatcggcataagctttcgcttgtgacggcttttctgctaaaataacggttttcatcatgacgatttcactctctttcttgttgtttgccttgttgaaacaacatcgcacgtttttgctttctgatctcttgttggtggatttcatgcttcaattgatcattccaatccttttttacttcaggtacaaattcatgttcatgatttttatagcctttgtagtattgttctgctttataagagaaaagaatctgagcattaatatcccctttttcttgataaaaacgatcaaaatcgtacgtaccatccacgcgttcacaaccttttaattcttttgcgacttctctacaaatatctttcaaattaatagcttctattgaatcgttaacagaaagctgctgaccaaaagacgcatttactttgtgagcggaaaccagttggtacgttaattgcagattgttttctgtcttgtgtatggccataattgcttcaggttcaactttcatttcttttgcaacttcttcataaatgactttgtattcttttggcacttgccaatcattagcgattcctcgttcacaacgtactttctgattcgtaaatggatcaactgcgcccattaattgttctttttcgtagaaaatatgtcctgcacggtcattatccacacaaatctcaatggattgaggaaaggcttgtttctttctcaattcagatactgcctcaccaaaataatgactgatcacatggtgttttaacccttccatagagactaaccacgtatcgtttaactgatcaagattcagtgcagcatagctaagtaaatcaatactactctcaaaaaattttaactgtttagggtcaccgatctttaggttaaatccatgattcgctgtcgaatttttatctatatgcttatatgtgcctctctcaccaaaacgttcataatcaatgaatgttccttgataactcgcccctactgtctcttttgtctgtggatctttccataaaaaggcgaccgcatgatccaaacgatcgtctcgaactaagaaattttgccgttcatgttttggctttagttcggcgatcaatccttctttttctgcataatcaatcaaccaatcgggcagttttcgttcttccttcaaataattccttcctttttctgtgagtggttgataatcaacggggtgatctttgtacttttctgtctcaaaatgaagattttctactcgttctgttttgtcttcattctttagaataaaatctgtggctgctttaaattgttgcttagagtcttgaatctctttgtctatgaaaaaaagtttagctaattcaataatgtcgccactaatattttgactgttccaataaaaacgttgttttcttcgatcaaaaacaaatgaatcatggtcttctaagcgatagtctcgtcctttattgactacagccattccattgtttcgagcaaaatccactatatcgatctgtttacatcgatcaataagactcatttttttctcggtcattttcaaacctcccaaaagaaaaaagactatccgtttttcagatagtcttttttacttgttttatacgcgttctttttgtgacaattgttgttcataatagatttcattttttcgtttggccacttctgacactgtttcaagtgaaaatcggaatggatttcctagcgcaaattcttctgaaggtaacgccgtttgaatctcttttccataactttttccttttaaaatcacttgattatgctgcgtatcttcaataaacgccgcatccttcaaatgtaacgttcggcccgtgtcttcttccaggactttcccgtctttcttgtcgatccaaagtgagccaacgagcacaatattcttttgttctgctgtttctacaacatttttctcatcctgcttcacttctgctggctggatctctggttctctttctctgtattgattgatttcattagaaatggtttgaatgaattcatttgcgacacgactgacatcattcatgattttcccacgttccgcagcttccttatcatccaacgtctgaccattcttcgtccatgtcgcaatataaggaatagctttctccgaggtgtccatcccaaaatgcttgcacacaatataggaggtcatttctgcctgtaattcttttgttgcagtatctaattctgaaaatttgtgcattctagcatgggctaattcgtgaatacttgtggctaaatgctgcgtaggagtatttcgagtattcatgacgatttcttcttcgccagtaaattcgttacgaacgtacgccccacgtgcttgtcctaattctctttgatagacttcactttctgtcatatctcgaatttgaattccaatatttttggctaccgcttgaatcccaacttgaagttctgtatgccctgtttgatccaattgaaaatcaaagacgcggttcgggaagattttcggatagtcttcaggcttcaattgtgtttgtgtgatatcaaacactttttcaatcgtgtagtaaggttttttgatcacttcgatttgaccactttcgattcgttttttatcttctggtgtagcctctgtttctcgaacaaagccacgtcctttctcataaaatcctttgaccgtttttctgacaaagatcttgttcccttgttccccttttttgatatagattccttcttttttcaacgcggcacgacctaaacaagccgttgcgcctggaaattgttcctcgatcaataattgatttctaaaggatcgttctggaaaacgagacataaaattcaaaagttctttgacgtcttcaggtgaatgagtatgctttttcaccgcatcaagcgcctgttgggaaagtgatttgacttcttgcttaatctcttctgccgttcgtttttgataacccttttgttttgtttttgtctctttaatctcattttgtacttttgaaataggttcatttttgactgtttgtttttgttccttctcaggtacttgttcgcacaatctagctaactctaaatagatggggtgattattattgacgccatcccctagatccattcgtatctgatctactacttctccattcttcacttcttcaaaatagaatttataatagcctgcttctgcggcgtattggttatccagtgttttgagttgatcgatcaattctagtgttacgatctccccaccataacttttcaacccttttgctggatcattttcgttgaattctactcgatagaaatgatcggtttctttctccttcacagaatcagtaggtgtagcttcttcaagtaattcacgaacagctgccttttcttcttccgacgtggcttggtattttttagattcctcaaatcccccgttttcattgagttctaaagcgacttttcgatagcctttcagaaaatagatagttggattctttttccattgcgtcactcgtccgctgtcaatgatcgcttgtacttcaggaagaatattttcttttcctttctctgatttttctttcagctgttctaatgtttccaattttcgttggtattttcggatcgtggcagctgaaaaagtcgattcacctttttcaaagcgttcgatttcttctttgattcttggaatattttcgatcgtcatatccaggccaccgtacttgttataacccatttcctttagctcttcttgtctttcaagtttttctacctgtttttcttgttgcttgatctcttctctcagactttggactttattttcgattcgttcttgttgcctaaaccaagaatgcccgtttctcttatcgttcattggttgaccgttggtctttctttggtgttcaaacatcttttcgatttgatcatttaattcattttgcaatcgtactaattttcttttggattttcccaaacgactattgtctagtggttctttttcttctgccatgtccgtttcctcctaaacaaatggataatcttctgccgcatcgacgaacgtcttcgtagtcagatttaacgttaaaatatcgccattttgatacgcttttgccgctttgtctgtgacgacaaaagctctgcctgtttgaatttctgtcacaaaaacgagattgtctctgcttttttcaacaacaactccaatcgttgaataagccatttcttcttcctcccttctctttcttttgatataatgtagtcgcaaatcgcaccactcattgaattggcggaaaacaattcattgaaaaaaagagtcctggacaattacgttcaggactcttttacttcttttattcacttaacaactaacattctgtgagtgaaatagactcttcaatgcttttacacgggaagttattgatcccctcttcattcatttcccaagtagtataataaggcgctaactttactgtctttactgtctttcttgttctatttggattcttcgttgttgctcttcgtaggctttacttgcgtggtatttttcttcatgggcattaatcgttcgatttaattgacgcaaactccgttgcgtgacaactctttgttggaattgtttcctgcgcttcatgaattcttcgtaactatatttgtattcattcgttggtaactgtttaagcgttcgaaaggatcgttcattgtaaatagattgcatctgatccatactttctattaaaggttttatttgactatcctgtttcttcagttctgttagaatggcatttcctgtgcgctttttcaaatcaaagagagcatttttttctgcatcctttgattctcttttgctttccccataaagactttttgcttcttctttcaatgcttttgaaatctgtatatattcttgatattcaggttcttttgttaaaacatatttggttaactcatcgagtttctctcttgtgtatggtgaaagtttggttcgtttttcatccccataatgccattccgaacgtttgtcaggtagggttttatatacttcatttaataagttcattgcgtgtcgatcgtaacgcgctggctcttttaccacttttgttaaggtgttacgcaaatcacttttccgcgtcaataaatttcgtttctccataccaatcattcgatccttttcataagaaaaacgttctaactcatgtacataattggtcttcattgcgtctaatgttgcttgtcttctcttacctttcggtacgatataactcacaccattttcaacctccgtgtaaggtttacgcgtattttctttttcaacaactgcaaaatgaatatggatatgtttggtattacggtgaatcgttgccatccagtagcctgtttcgttcagttgctctttctcgaataatgtctccatcatttttcttccagctgcttttaatccttcttcatctaaagtatctgttttgggatcgtacaatcctattttttcaagatacgaattatcatgagagacaacatcttgataaatgattgagcctttttgttgtcctctttggaagatttgcttaatctccttcagatcacttcctttcacttcgtctgaagccatagaaaaaactccaggaaggtttcctgaagcttttttgtgtggctctgtttgatatttttttattgcttggttcaagcgttggtattctttttgttcactttgcgtcagttctttcttttgttctaacgcataatgacgggtcatataagaaagatatttggtaaaatcttgttcctctaacttgtcaaagttgattccatttcccatcaaagattgagcttcattcgacgtttcgctgaattctttatccgtcttactctccgaaaaagtttctccttcaggaatataaaaatcctctaaagcattcttgattcgttgcagttcctgttcttcttcaggcgtacgtcgttccatttcttccagcgctttttctcttgtcatataatcaatgtatgttgaaaaagattttttattgggcaaggtaaattgacaagtgagaatgactgcaggcgatttattcatcatattccccttctactttttatctttttaaaaactttgttggatcaaacgggtctactctggcatgaacagattcatttattgatttcttgattttaggagaatacttcttcgtttgattcgcttttattttcccttccacacgctcttttgcttcttgatagacagttgaatttgtaccaattaatattcctgtatctttcaaatgaagatccgcaaactctgaaaccatttctattaaaatagaaatttcctttcccattgcgttcaactttgcgttcgtcatattattatttttttcaatttctggatcgtaattcatacataaaaatcgaatggcttcagaatagttttttaccgtaggctgagtttccataatatgttttaaaacttcatcgtgcgcttcataaaatgtaatatgcttttctatcgctttaaccatagaacattatctccttcctaatgtgcgattaatatttcaattaagttcttgacctcgttcgtgtatgcttccaaaacttttgtattatgcagctgaacatctgtaaatttttccaataaacgatcaaattgatctttcttgtagtccattaaaggacgttcaaagtcgttttcaatcaatagttttagataatcatttcgactccatttttgaccagtttgttctgttaattctacgcatctatgatcaatttcttgaacatattttttattaatacctcttactttaatctctttaatttccattttcaccctccgaaaaaagtatggatagtctatggagtctatccatatgctatccatgtatagctgttttactatccatacactatccataaatcgaatattttgtacccacttttgttttagagaaacgtaataggcacagcctattggaacactttttttaaaaagtgttcccacgtttccttatgctctttaaaaattaaggttatttgtgtatttagacaataaaaaatccttctaactttgtcgattagaaggaaatattttgtcatatgaaaaatgaatttaagaaaaagtgtatgctataattgatacgctgtcttcctgtttggttgaaatcttcagccagaaaggaggagtgttaaatgttttatgtgcttgatgtttgtgttagaatcgtggttaatgttttctcccatctctttaacagctatacctaaggtgatatagctgatccataaacatttttgatatacttttttcacataaaatcctcctgtttttattttctttcagccgtaaaatattttttagcagctaaatacaaagcttcaaatgatctgaattttaaggtatctaaactctttctaccattcttcaactcagatattgttgtgttagataaattcacttcttgacatatttctttagcttttacaactttgagataggctttaatcaatactttctgctcagcgaaagtatctttaccgaccaagttcgctcgcttcatttcttttactccacctattcttctaaatattttcttttgtcatacgatcaattttttcttgaagtttttgaatgatctcttcttgatctttcatttgcgttttcgatgtttcaatttcttgctggtaactattaatcttattttcagtattttcctgatcgtctgcaacttgataaggcaattgatcttttagtttcttcactaattcttcattcaaatcaatggttgcttggaaggattcaatttgtttttgtgctgctttttgttctttcttgtatcctttcactttgtaattcatcgcatgttgttcataatcttcatctttcacttgatctttaaccttatcttcgtgaacgtaataaatcagatcttgtggttcttgcatatccacttttggatcaattttttcaggaataatggttaaacgcatggcaatatattcttctggtacatgcgatagttttactgcaaaataatcattagacaccttaatcactttggcttttattgcttgataatctcctttagctgtctttacttctacgcgataattaagattagccagttcttttaatgagctttgatcttcatcgtcaatcgcaaattcaaaaactaattgctggttcgctcctttttcttttgaaaccatcgtcagttccttcgtgtttaaaaatgcgttcgtgcttacttcatctggtatgtctacctttttatgtgtgtaaatcggactagcaagaatcaaaaagccgagaatcataaagattcccagccatctaagataactttttcgttttttgaaacgttgtcttgctccttttttcttactcattttcttcctcctaacgagtgaaataactaaagtctgtgactttccattgaccatctacttgtttttcagtgacagttaatccaccttttattttttgcggtttgacatctttaaattgaggattgccgattgtataatcaacaaataccacaaaattttgttcctcttttacactgcttgtttgagcgtaagtttgcacgtcacctaatgtaaaagagtaacttccgtaatcatcatgttggtgatcatcgtctgcaggacttaatttgtcgatcacttcttgggttgcgacatcttttagtttttccgttaattcatttctgcttaatgatttatcaatggccaattgaccgaactcttctgccgtctttctttgtgcttcagtgacttcctcttttgcttttgtgccatcttgttgcttcagctgatcgatttcttggtttttctcattgatggtttgatttaacttgtcgatctttgcctgcgctgaagaggaattttttttgagcttctcagacgcgtttttagccacttcttcaattttataggtatttgtcgcttgttcctctttcagctgccaaaacaacgcgatattgccgattaaactaacgctaattgcagctgttaagacgatttttaaagttttattttccatattttttctcctgatctattttttgctgctattcaaaaatggtaatggatcgatccatgtaccatcatctgtgaatgcgtgtccttgtgcttgacgccaatccattcgagtgaagcctaaatgcaagtgtgctgtatctcgtatcccgattacttgaccaactttcacttgatcgcctactttcacacgagaatttcctgtactattcgcaaattcttgatacaccatattcaagccatcgtaattgatcacgatcacacatgcgcctaaacctgaaataccaggatttccaacgtacacgacttttccaccatgaaccgcatgaatctcacttcctggatgatcaactgaaccaaagtctaatccatcatggaagccattcggacggaattcaccgcctggattcgttccaaataattgaccaccgctgaaggaacttttatctaaactgctgccagggaatggattcgtccattcaccagtaattgtgccattatcattaccaccttcaccccaatgtttcatcgcgaattcatcatattcggttaatttattagaagtgataattgacatacaacctgtataatacggactatcttcagtaattcctgcagcggcataaccacctcgtcctaagatcaataagcttgcgccagggcttttatttcctacacatgcattaaaattggattgtgtggctaccataaagccgtaataggagaatgcagcttttgagttgggaaacttcatgtaccagcccccttcaatgccaccaattcctcgtgcagttcctttaggaaacaaacacccatcaaaccaagtaatcccaaaatagttgagatcatttctagcggacgccgacgtaccaaacgctgattcataaccgtattgcgaaagaatcacacttggtaataatttatattttactgctgcacctacggcatattgcgcaatctcatcagaaaaagggcctcttcctttgatttctttataaatgggtaatccttccgaatattctcctgtaaaagcttcgccaccactacttgaatctgaatcagaattatcaatcgaacccgccgcaagtattagaaaaagggtcacgaacacagtaatcaaaatagtaatcaaacctgcagaagtaccaaacaaccacaaaaataagcgtcgctttgcacgacgcttaacatactgcttgattaaactttcattttggttttccattattttcctccatcaaacaattttaattgacgtttgttcggactaaaatgaacacgaatggtttcttttgagccaaaattgatcacagcgtctccttgattttgttgaggaatggattctaattctgagttcgtcattgatttaccaactaatccttctatatgacgtaaaatagattcatccatacgcataaagatcttcgtagaagaaaattcaaagactttcttcagtttcgagaagttatcagaagacatattttctggcaccatttcttgtggggattgtgtagctaaaacagtcattgcttctactttacgcatttctcgttgaaagtttgtgacataatttaccgtttcaataaaatctggattaatcgcattatggcactcatcaatcatcgccaagaagcgtttgaagtcttgttcttccatttgtttttctttaattaaacgtcgttgtcttcttccttgaatcaatgcctgattccaaatcaacgtcatagccatgtacatctgacattgttgtacccctcgatctaagcctgtaatagagtcaatgtcaaaaaagaccaactgttgttggtcaaggtgtcgaatcgtactatgaccatcaaaaatcatgccatacgtctcacataaggattctacgatggattccatttcttcttttctattctttttctcttgggaagcacctggtaattccagttgtcctaaaaagtctaaaaattctttgaacgtcggataagcttctggatctttccctgtgacttgcgtctccgtatttgaacgcgaatttgaggaagtaaagccgcgtggtactgttccatactcttcataaaaacgatttaagtaggtcttaaattctgctttcatcgttccttttagctgaggactcactaactgtacctgatagaccactttgtctaagtgtgtttgataggacgctgcttcattgatcttcaaatctttgactgatctatcgtcatataaactggatgcttcatcatacgtccgtgtggcaaatatttctaaaggattgatcatcccgtcagatccgtctaaacgcaccataataccgttatattcctttaagaaaggaataaagtcttttcccttttcaaagccccaaataaagtctcctgcagctaaatgggcttccgcgatcattttaagaacggtcgatttaccagctcccatcattcctagaagcaaggtattagtagacaaccgtacactatttttatacgtcgcattccagacaaatgggccgcctgtcatggtttccccatattgtgtacctcctggatcttttagcgtttggtggtggaacgggaaacctccgccaatgtttaacgatggtagtgattgccctttgatatttccgaaccattcagcttgttcatcgaacatggtaaacatcgattgccaatctcgtttggttttatgcagataagtcaccgcacgataatccatccctttgagattttcgattagttcctgcgctcgttcatctacttcttggatcgtgtttccgtaaacatgtactctcactttgacttgtttagaaatttccccattagaagtcaattttcgggcatattccgctagttccaggtattcttccgcacttttatttcggtcagtcgcttttcgttcattatctgatcgatcatttaattcatctaatgcgcggttgatttgatcaatcactttttgcttttcatctgtgctaacatctagtgtggccactgtatgaggattgttcatgagattggccaaccaaaaaagagtaggattttttgtgtagtgataaactgtcacacaccgtgaataaccatttccataggtcacatactcttcatcgaaatttaatccaccttgtggcatcacttgttttaaaaaatctaaatcataccctttggattttaaaatttctatttcccgatttcctagttgctttaatggatcaagtactttttgatcattttgtggtgaaaaagctgttttaatcgcttctaacatgtacagtcacctcttcttgtttgattctttacttggttaaaagattgcccttttcccaacttacccatgcttaaagtgtgaggaaattttctagtgatctcttccttcggaatatctttttctaaccatatcaacggatatttcattctctcttctccattcctactcatcattcatattgttcattcgataaagaatcttgatcaattcttttttgtagagtggttttaaccctaaaatgccactagatcgcattaactgacggtttctggtttgtaaatccttgattgtctttccttcaatgatgaaaaagaagcttaagtcaggacgttcttgttctgctcgtttcaattcctggatttcctctactaatttcttttcatattttcttaatcgctgtagatttcttcctaaggattgttccatacgattcttatctaataactgccgcttttgtacgatttgttccgttagatccgtctctgtggtcaaactaactaactaaattgttggcacatacgtacgcatgacagtggtcaactgattcattcgttctagtttctcttgttcatttaatccttccacgtctgtagaaactacacgataataacgttgaaaatgatcttctttagtaactaagactccctcttctgtacaggatttataaggaaataaatccaagatagatcgttcttctggttttccaaactgaaaaatggatttcttatcaactgaattttgtccttcgactcgcatttattcatcctccttatacgtaccatgataatttcggttaggatctaacgcatgataatggttcttgtccgtaaaaaaaatagactcgataatcgcaaaaatttgtcgttgccctgggttattatagggtcgccaaacaatcactagagctatcgcaatccataagccataattcaagagtgcaaaaaagagtggtaagtggacaagattattgactattttcgcccaaaaaaagcaaccaccaagcgttaatagatctaaaaagaaaaaggcgaaaaacttccattccccactaaaccttgggggatttttcatgttaatgtatttatccataaatgatttctccttttcatacatagaaaaaaggcctaacatgtaggccttttatggtttgatatcctgtttgatatccctcaatagttgttctttcaactcattgttcctgtttttagtttctcttgttacatttatttttgttggtgaagtaaatgccacatttgctggtttgtaacctgtgtgaactttttgaataggttctggtgcagcttctcttgtcacaacattttgaaaggacgcattccctgtctcaccactttcagataaattgtaagaaacagttgtcagatttccattttcaggcaaacgacttggtttcatttgaacagtacctgcagttgattggtgaacaaagctttgataattctccttgaattgattcaaacgactatctttcattggtaaattttgtgtcttaggcaaaccaattttcgttgatttttcagttccaacttcgatgccattatcatttggcaaatcgatggaatcctcatccgtttgtacttcttgatttcgttttggtaaatctgaaatgcgcttttcattttcagaattaatgttagatttataacgatattgttctgaatctgtttttggtaattgaccattttgttgttcttctgaattttcgttagaatgcaactcatcttggtgatctttggctgaaggaatcgctgcaccttcttgattttctttttcacttgttgtatttgccttcactgctgcattgacttgtccttcaccatacgcatcttttagcccttctttgacttctgaagctttttctttttgtttttctagtgcttcggatggattcttaacagcttcagccaattctttggctctcgtgccgtctaatttctcttctaaggtgtctttggctttttctgtaagatcttcagctgttccttttaacccacgttcattgacgtaaccaagaccttctgcggctttagaaacaccatttttcgctttcccgaacatttcggaaactgttttcttactattaggtacaattgtagctttatcgtctgattgttcttccccgttatcaggaataacatcttttcgattgccaaatccatttttacgaatatcatttaaattgcttaaaccactcttaccagcacttgcaaggtttttagccccactacccacatttttcgcaatatttcctaaggcaaacatgctaagaagagaattgctgccgtttttcagactcgtatcaacgccgaaaattttcgtaactgattgagagcctttgaatagcgcaatggttagtacaatcaaagcgacaacatacaagaatccattgatctttcctgccgcatgcaaatcaccgatacctgaaagcattaatgtatagattcgtaattctaaaattgtaaatgccaataacaaaaaggattgagaaatatcttctatcgcacttttcatccgttgtcctgtctcaaagtccgttgatgcggcaatcactaaatagaattttttaaataccagctcaataatgcaagtaacaatcgtaaacaagataaataaataggctaccgacaaagaagattcaccagctaaaataatacctggactactaatgtatcggcgatagcctgaagtatacacatattttgctaaaccttcatcactaatttgaacagggatttctttcccattatcgtctaactctagtcgatactgtaatgcctttaaccgatctttttgtactgtactaatatcacttgattcagacattttcttagcttgatcaggtgtaataatcccattgatattcgctgttttaaagtttttcgccgtgagagcatttcttttgtctgttggtatgtgttctactttgttcggatcattttctagtaacgtactcacatcaatcacattattttgaataatttgaaaagcaggtgaaccagttttatctgctttatttgctgcagttacatctccgtaaaagtttttactgatatttagcccttcatcgattaaagaactaccaccaaaaatcaaaatcatggccataaataaattgaccaagatattttttggttttggtgggtgcttactcatgaaaaattttaaacctaaatagattaacgtgacgacacagaaaagacctaaaactttactaatcaaactttgaaacagttcattaataccagcggcgttcaataagtcttttaaatcaaagctttgataaattgttttttctagtaaagtattgagattatataaccctttaatcaaaccccataaaaaagtattacaaatccaactgaatacatcttgatactgcagataattaccataatcttgtaagactttcgttacggttttgggatctgcattcccatctccaaataagcctgaccaccagtcggcaatgccggaaaatattcctccaatgatcattctttcaccgccttttcagcttctagcaaaagtcgtttccttataacctctgtaatttcttcattttgacgcaatttttcaaggtattcttgcaaacgatctatttgcttctcttcataaaattgaataagtaacttttgtgctgttgagttgtctaaagattgaacgattttaataaaaatgttttctttagcttccgcttctatttgatcgtgcatattgtgataaagtcgacgtgcatagatatcaggtagaaaataatcgtaatcaatttgtaaagccttaagatccaagtccgcatgtgtacaatgtatgtctatatcattgatatcccacgatggattgaaatcttcaatatattgataagcataaggaagatttgtttccccatgattaaaaataggatacggccgtattttatgacctttcaaatcttgtcgttttaaaggagcgagtacaatcgtttcaccttctaaaaaagtagaaattctttcaggagttaagatacgatctgaatcaacattgcgattgatatgagtattcatacctaatgaattgatggtactgttctcttgttcaaccgtcttattccccacttttttagaaaattcttcgatggtattatcatctgtcgacataatataaatatgtgtctgacaattttctttgataatcgctgcgttttgttctccatacttcgcataaagttgctgataggattgaataaacagatcccacaacatgtttctaccagctgtgactgtcatgattccttccatattatccattggtggcatattcccaaattcatctaaaataaaatgaatcctacggtgacatttatctcctttagtcttaacacattgcgtagataattctttatacaactgactaagaaaaatactaacaatgatatggttagatggatcataatcaggtgtgagcataaaaatagccattggtttatcggtatagtgcatccgaatagattctactaataagttacttttatcctcatctaatgttagaacggcttctttttctaattctggcaaatgggtttctcctcgtttttttcgataaacgatatttccctcttcgtctttcaatactctttgagaaaactcataccaagcaacatattcttttcctcgatgatcgtattttaagcaaacatgatctccctgttctaaatgacaatcaaagttgatttcacaaaaacctctatagcctactttgacacgttcctcatgaaatttttttccttggtgataaaactctacaacaattcgctggtttaacagactctcgtgtagtttgagatccaaatacttcggaaaaccaatggacttataatcaatggttgattgagaagtcattttcgcaatcttcgtcagtgtaaatggatttagtcctgtgatcgctgtcgatagaatgttgcctttcgctttatcagaaccaatttttgttgccccatattgtttttttgctatgtttccaggtggtaactgattcataaattcatctaaagcattgagctgcttgaattcattatcaggatcttggtaattaaaaccaccaatctcagaaagaagttcgacgagattattcggtgttaatttggagtaatcccctgtctgatccgcttgttccaataacgcaaaaataagcgcattgacagctttttgcgcattttcgttaaagtatttattgtctgaagcgttggcatcataataaatcgtattcgtgaaagtattggttaactgtgtcgctgtgtctatgtctcctcgcttccagtatttcacgatgagtgccaatggattatcactcattgattgcagtggatcggtgatattaaatgcatacacatcataccctctagcttctagttcatctttactagcaacatataattctgtttttggatcattaacaaccattgaactttgtctttctgcacgagacaaattgtcaatggttgctaaaacttctatctgtcctttccctgaacgggaagtaccaataatacaagtatttactgtatccgtctgaatataccagtactttttataatgagtaattggtattccgccataaccaggaaaacctccctttgattctggtatttgcggataaatttgttggatttcctttaacgtttttaatcggttatctcctttttgcccatctgctagaggacgaaaccacatgtccattttcaatcccataagtacagctggaacaacacaaatcgtagaaacaactaaacgtgtgcctaaacttgttgttggggtcaaaggattccaaaaaccagttgaatcaaaatggaataactgcggcatttcttgtaactgaaaaatattcactccttgtaaacttcctggaataatctcaaatcgatgaaatgcttctggtattcttgtaacaacatagtttaaaggaagataagctaagccactataaaaaatcttttgagaaatacgtttgtcatgtttttctggtagctcttctcctgaaggagtatagcgatagaaatgagaaagatacctattcttttctaaattgaatcgtttgtcttttcgtctcgttgtttctctaacacgcattatttcacctcatttgattctgaactttcggaagtgtttgattgtacagttgaatcgcttgatccttctttagccttactaggatcactctctttgctattttccatacttgactctgttgttgactgattggtacgattcaataattcttctaattgttgttcatactcttttcttgcttgttcttgggcttcttccttgattgacgtcgttgtggccacagaatcagcctgtgaagattgattgatatgattaaaagcaaatactgttcctccatctagaagcaagcttaaacttgcaatacatcccaccatccatccgttaaaggaacgctgtggtgaaggagttaaatttgcttggttgttcactggcgtttgaacagcagctactggttgaggttgtgctagataatttaactgtgcttgtcgcaatgtatccatttgttcttgacgttccttacgagcagctgcttctttttccttttcttgctctaaccgttgtttttctatcgccattttttgttccgcaagatcctgttcacgtttttttaattctaattgttcgcgctctttttctttttgccgttgtttttcttcttgttctttcaattctcgttgttgaatttcatactcttttttccattttggaatttgtacttgtaattcttgctggatctgctcgtgtttttccataagaacttcagtcgttgtttgatatagcttattcagttgctcatttaattctttgctaatctttagcttatctgtacgcaaaccttgataaaattcttcttttcgttctcttatacgttcttttaacaagttttctttttctttcgataacgcttcttgattcgtctgagtaaaattattgatcttttctacacacaaggaatacgcattgtcgcgtttcttttcgtatcgctctttaattttttgtacttcttcttcaatcactcgctgttcttctttatttagttcctcttttgctttctcccaattagacgactgttccgtcgcatactcattaatttcttgatctgtttcttgttgacgttcttcaaaggtggctaataaatcttcttgtgcaagctcatgccaatttgttgattggacagactctaactgttctaaaagtgtgcctttaccctgtgagattaattcttctttactctctaaaaatgcttgataggtttggggtaattgatatttcgaataaagcccatttaaaaataatttgtttttttctttcatccattcatgctctggcggatattgatccaaaatataatcaaatacagttgccttttgtatctctgtttcgtttttctctacttcttcactgataagtggttcaatatattcctgagaatccccttcagtccatattgactcttcattagcttcaactggatcaacttctacttcggccgtctcttcatcctccattgtttcttcaaagtgatctacctccaattgacccatcacatcattctcttcctcaaatatcgatttctgagtcggaatatcagcttgttcatcaacatagactgtctctttttcttttgactccttctttggaaatattggtcgttcccatggtacttcttcatttacttcgacttcactcccttgattcacttttctttggtcgctctctaactcttcttctaaaacttgtaaaagtttttcgtttcgataagactcttccacactcatagtttcatccgtttctttaaacacatcaaggcggattaaatccaccaatgtaggatagaaaccttctgaaatttgataatccagtgggccaaaaacgtattctgtaccagctttctctatttttccttctgtgtcatgtaacgtgagagtcaacttaacagaagatcgactttcgtgttccagtactttccctaacacatgtagctgttcttccgtttcaatgacagaatatttaattgttttcggtaaaaaagaagtacgctttcctacttccttcgttgctttttttattaactctttatctgttttggtattgcctgcaatcgtaaagtacatgagtattctcctttcataaaaaaggagtaaaaagtatcgactacttcttactcctacttttttactttcttataatccttgaggtgtttgtccaaacaatccaaataacgaaaccacaatagaagctgctgctaaaataactcctacccccatcaatacatagcctacgtgcatcttcccattttcagctcctcttcgtccaaataggaagaaaagacccccaataacaatggaagcaacggccgcagcagcagcaaaaatcatcagattgttttttaaactagttgcggcagtttgtaatgctctaaaaatatcaaccgcagctactactttcggttgtgttaaaaaattcattgtaattgattcaaacataaaattgttcgctccttttagtgtttaataatttcatcgaaaacaagcttttcacgttcacgttgatagatatatccttctaagtccttgtcttttccccgtaataggtcaaattgtgctttttcaaggacttcttgtttccactgtgtttcagatacaccgcggcgttctaagattttagacgcggctttttcaaatggcgttttagcttttgccactgtgattcctccttcaggacaaataaaaagactagcaatcactcgctagtcttttgtaacttatatttattggattgtgatccatcgtgaatcaatttctctttcgttcgcttttcatccttgctagatccaagaaaaattattttttttacgccattcttctcatagggaacaacaataaataaagaatcagatttgtttataaattccctaacaccagctgaatctactattttgtatctttctaaacctttatagtctttttgcctcttgactgttatttgtacaggatctggatgccatacactctcagagtattcccaggtagtctcgtctataattttcaaattataaacaagaccacctacttcttctttccacatagttcctgatttcaatacgccattatcttgattagtttgtttatttttttcattactacatccgactaaaataacaatcatggcaatcaaggaagtaactactattattaactttttcattttattcattctttcgtttttttattttaaatgtatctcagaaccgcataactaaaagttgctaacacaagtaatagcaagctgaccgctgaaatcgttactaaatgtgtagaacctgttttaggaacaatgacctgtggcaagttaggatcaaccccaattgtcacaacatttgttttattagaaacattatctactgctactacggcttggttatcaatatttttttctgattgtaatggagttttagctgtaaatatcagctgaatttctcgtccatctaaaagattgttacttaagaagtcagcggaagcttcccacttcagcgttcttaaattgctatcataggttagtgtgccttcagaagtaatatcttttcctttactcttatctattacttgcgcagaaacttctttatatgtcaaacgagcttcaattggatcttgaatactaaattgtttgtagtgatctgacgcagcgtctacgccttttgtgtgccatttttgtgtgactagatattgtacttcagatcctgcgtttaaaggagctgtcggcgtacccttcttaccgtcatttcgtccgtttacatcttttccattttgttgtacttctttcactggaattttagggaaataaacggtaatgatatttgtatccttttctactttattaatgatcgacgttccctgatttttggctacactattttgattggccaattcattgacttttacattgatcactaattcgtaagtttcgccgttatacttcattcgattttttaatgtatcagctttcgctgcatattttacctggtgttttgttttgtcataggtcacttcaccagatacatcgaattttttatttgtaccactttcaacgtgtgcatcgacgtaatctacttcttttggtaaattatcgattaactcaaatcgatcgtaaaccgctagtaaatccactcctaatcgattcaccttctgtttgattcgatattgaatcgtgtctcctacttgcaacatgttatcgttcacgttatttccatttttatcaacccctgttttttcaggttgatcaggaacaacactaaagattgtcgcagaagataaagtaaaccaggtttgaacattagaagaaccaatcacaaacgtcggatttgcttcagatattttaaaggacacagtaccttgaccaaacttcggatctcctaatttatcatgcaaattattgaaatcattatccgcttgtgtcagcttagagcttcctcctgggtggccacctaccacgttcagattgttgtagaaagatttaaattctgaaagaaccgtatcttttctgacataccaatctgttgtattcattttgtcatagtgggtatattctcctttaagatccgtgctttttcctcctgcagggttcaaagagttaaaactgataaatgtatctcctgaaaattgaacggggctaccgtcctcatatgtggctactagctgcacattcatttgtgttgaatggtaaacaattcctgagaaaagattgtctgagatccaaagtactgttctttttttagatttactcattgcaccattcgtatttttatagccatcgtctcgaaaatgagtttttgtatagttattatctagtagattccacggcaacgtatccgagtataagtgaatattagataaaactagcttgatattgacttttttcccgttatacgtaccgatttttccatagtcaatattgactttggtgtttgttgttacgccttctaaaacaaggtttgtttcaccgtattccttttggaaagaaggatagcgtatatttttgtttccctccactaatcctacgtagtcgtctgtaaaaccacctttgttggcatcaacatgatatttgtaaacttttgacgctccgtttacagtaatatttgtttttgcattaggaacatcttttggaataataaaattattctttacgttctggattggatttgacggatcgacaataactttttcagcaaagacattggctgtttttaacccaaacaatgtacctaacatcatcattatgggaaaaacatattttaaccgtcttgtccacgagtgtttaaaattcatcccttcatcccctcttttttataaatgactagtgaaattccgacaataacgatcaaattgatcgtagtaaataatggattcctaatgagcttttccataatatctagcggcatggaagcagctggtatgtttaaaatcctcattaggtatagttggtagcttggcaaaatagatagttgagaaaataataaaccgcagtacaaaaagactgcggttaaacaagaaagattgaataataataatttgatcagtttcatcttatttcttccttaatctctagaaaacaagtgagtaacaaaatcccaacaattctcaaagaagtttttctttacgccagtagatacgattttttttacttcttctttaggttgcgaagcttctgatttaggataaatccacacatcctttaagaattcaccatttttatcagaaacaggtgttaatagcaaaatatcctcgctattagaaatgttttcaggacttgattcattgacaatataataagcttgtttctgatttgcctgtacttctaccgagaattcaaaaatacctgtttgttgatcaattgtctttgtttctccattagaaattagcttcagttgatcactggatagttttttcactcgatcttttaattgggattcaatttggtcagtagtgagatccttaacatccatcttttgtaaaatgtccgatacatcataaacagaaaacttcgcgccatttactccttcttgtttttcaagcttttgcccctggttgtctaattgttcggaagaaataattttttgaacgtgaatggtctgtttgactatttgatcgtcttcagcaattttaggttcttctgaagaatcaactgttgacgaatcgacggtttcatcgctgctttgaatcgcgctgctatctgacgtttggattgtttgttctgtgctatccgtgctttcttgactgtctgcaaccgtcaactgtgtgtaggcagtgaaagtaaaaagagcggctgcacaaacaaatagccattttctatttctcatgttggttaccctcctttattttttctttttataaacaaatagcgaaccaatgatcatgactgaaagaaaaacagtacttcctaaaagccatttccatgataatttttgtttcttattttcttcatcttttaattctgattttgtaaaggttactcgcttcccatacactagaaaacggtgtgtgttgatccccttaggcgtacatgtcattagcgttactcgatcttcattgggatttggttctaagtaagtgacaaagtttctttgtagttcgtctttttgcacttcctcaatccgatcgatttgataagcgtgctgctcaccatcaactttgatataaaacttttctcccttttttactgaaggtaaatcatcaaaaagattatctttataaagtccactatgacctgcgattaaaggatttttaccgtttcctcctgtaatatcaccagttccttccgtaatacctacaccattttctaaaattttgtcggacgttccgtcataaattggtagttttaaagaaatacttggaattgtaagaataccaacaggatcgcctaactcaatcttagcaacatccaaagaagaatccgtttctgctgccgttcctgttcgatcgattgcggcaatctgctgattttgttggtatttcgccacgctcgcttcagcaggcatcaaaagtaagacacctacagctgaaagtaaccagaaagcaatgatccatttacccatgattcgctttttcttaggcttcctgataatcattggttttgatccttctaggctttcttcttaaagtaaacaactgcagaaagtgcccctgctcctagcaacaagcaagagattaatacatacgtttgaaaaccgttgctaccggtcattggtacggaagctttttgattgtttttgatcgtgattcggttttcttctttgtatgaatctttgtctactttgaaagagatctctttcgttaatttttgatagttttcaggcgcctttgtttcttccagtgaatattcaccttcagttaaaccaatgatttcaaagtgaccttctttatctgattttaggatcgctgcatttgctacatcgtctacccatactgcttctttgacaccgtctttatccgtatcaactaatccaccataatattttccttctgcgtttttagcagcaaattctgcgccttcaagcggtgttgctttgattcctgttccaaatagtccgctatcgacttttaagaattttgcaccataagtcacaacgtcagctttcgttttttcgtggtgttcttcctgattaaatggattgttgttataaacgaaatcaacgctatttgttaatagattggcaacagctgcgctgtcgtttacatacatgttataagtcatttgaagatcttgtccgtgtaaacttgctacagtatcacttacttggccattattcacgataaaatcgatcacaaagccattttctgaattttggattttataatctgtattttcttttaataccacagatccatctttatttgttactttgatatttgctttagcagcgacataagaaagtccttgtcctgctgtatccccccatttaaatacactgtaaggagaagtttcgcttttcactccgtttactgtgataccgtctgctccgcctgcaatgtctgttgggatatgaatcgttccttgataatttactgcgtcaccaatttggaaagaatgttcttgtcctgttccatttgttactgttttatcgatcactggtgctttatagtttacgtatgaagcttttaagtcacttgtcacgccatcattcgtaatttcaaaggttaatttattgtgcgcatcgttgcgagcgtctgcgcctaataaatattgatctgctattggttctttatctgatcccactacaacttctgaaggaacttccacaaaatagtattttcctaacgtcaaatcagtagcagtcagctttccttgatcatccgatacaagatctcctaattttgttccttttccaggttcgcccttgtataactcaaattttgccccttttaaaggtgtttgtttgctttgagctgtgccatcgtcaccaaatttcgttaattcaaaactcaacttagaaacaatatttttaggatataagtgaatgtcttttaaaaaacctgaacctatattatcagtcattggcgcaatcacaaccattggttttgctttttgtgtgactaatccagcagcggatttactttcataaaccacatatacattccctttggaattgacataggctggttgatcagcaaaagtgatctcaccattttcatctacagctgaagtaattttattggttgcattcttgacgtactcactgttagatcccttgtcttctacatctttaacgatttcgtccactttcgcgttggttagatcagaatcttcagtcggtaatacttgatccgtaatatttcctaacgtaaactcaacatcaccataatctgccttgttgtatttcgttacacctgtaggatattgatcgtgcgtataaccatcgtttttgatcccgtcaatatcaacattcaattgcgttccttgatcgtacattaatttatgaaccgtgatattgaccttctctggtggcgttttttgtgtgacatcttctgcatatgcttgatacccctgaaagcagcttgcaatgattcctaacattccaacaagcattccagctttttttacataccgatttattgccatttttttatctcctcatttcatatttcaacgactcgcgttgattaaaaccttgttattgtagctctccctgtaccacgtatctttcttttccttgtgacgtataaacacaagtaaacaacgttaataagggtttctctcctttctttggcaaagacaagaaagagttctcttcaggaacgccatcgattaatttaaagtactcaggtacgataaatttacgcgttaccttgtaacgatagaagccatcgttactaactaagtccatcacctcccctaatgataacttttgaatatcagaaaataaaacccctggcatttccatgttatgacctgctaggacatagtttcctttgcccatttcggcatcttcataaaaataagtagccgttccaagactcaaagtgtattgatttgcccctttaaaaattggcaatgctaaaccaagtgcaggaatctgaatttgtgcaaatacttgtttattgacgcccatttcgattgcttctttttgtatggacaacatttgacccaaagacatatcattattgacgttcgttgcatcctccttataactctttgcgtgtgcattgatttgatctacgggcatctttttttctatattttgcttaaacacctctccttcatgtttttggtagctaacatagccaaacacactgcaaaagacgattaaagcgactcctaaaaaaacaaataaccattttttcatccatctgcctcctttcagacaaaacaaaaaacactttttcacaacgaaaaagtgttttctcttattactattctatttcatttatctggtggttttatattggtgtttagccattgctaacattaagaatacaattggcacccaactgattgtagttaatgtttcttccatgaatgattgacacatgatcgctaaaaaagcccacaagaatgttagttgtccgtttgtcagctcacattttcttacgagcaaccataaaaaactaagcaaaagaataatcgatagagcaaaaccaatcaatccatagtgattgacgagtgcgtgatacgtattatgattacctagaatctgatttcctatatggaaaaagaaaggttcatctctacaaatatttgtcttgttttttcgcctaatgtttcatagaatttgcgccaaatttcttctcgtcctgtaaataaatgaactttgtctgacattgcagcaaaataagaaatcggtaaagctagaaccgaaactgctgcatacatccaaaaggacaagtgtgtgtttcgaaaaatcttcttaggtaaaatttctaggataacgaagataacaagcgcgtataatgctgctttcgattggcaaacccaaatcgttgccccagcaagaatcaacgctggtaatgatagcaatcgcatgtaccattttccaaatgaactagcaaatcctgtgataagaagagctaatgtcattaaagaactacctatcgtatttgtattgatccaaatatccgttaaactggttaaattatcttgataggttttagcttgttcctgaatatggattgtttttgttacaccatctactttttcagcgattttgtcctttagataaccttgataagcaaaataactaaaaaggagaaaaacaatgattacgcccacgtaaggattaaataaagttttattgtttttattcatctatctaccttctatatttgaattaatttaactacatctaaccaagataaaccacgttaaattttactattctttttattcaataacaatgccacatcataattgatcattttcatatcataatcgtcaagaaacttctaataatagttggcaattagaacttattttcacataagttcgtctcaactgttcaaaatttttcattgatcccaatagacaggctttctcctttcctgttatctgcatgtcactgatatattgcatgacagataaccttttaaggtgtttttgtttcatcgtttttagtaacttttcttccatttctttcgacacttttttctattttcgatttctttacaattcatgagttttcctaccttccttgttttgataaaaataaaaaagcctatgatcacatacgctctacacttcactcttgggttatctttttctttcttttaactactggccttgctggtttcaaatccttgattccattataggttctccaataatcaaactcttttcgtaatctttctttttccatatctgttcctttggataaggctttaaatacatctttaggtgaataactacgagctaacagctgtacataccttccttttgtcaaagtatccatatccatcgcatctaaaactggtcgcgccatctaatttgcctcctaaataaattctttactcgatgtctaatgataatactagctttttattattcgtcgtaatttctgcacattcttcttcattattttctgcgattaacgcataatagcatggtgattttacttcgaaaaatttcatgatctattcctccaatttttattcttctttatccgctacaaagtcaatgatttcaacactgacaatataatcactcaaatatgaccaggtatcttctacagacaattcgtctcctttgtcgttcgtaagcgtcattttaaaccactcatcgccttcatcatcttcaggtagcaagccgaatccaattggattatcagtcaatgtttaatcgtataaatcatcctcgtctaatgctaaaacatctaatcctttacaatttccgcctcttctaaacgtcacaaatcctttgtaatcccaacgttggaaagaaaccttaatagtatgtgtgcccaatcgtatattcggatcataatttttcatttgtcattcctccattacgtaaatttcattttctctatgttttatatcaattttttcactttattcaggacttgttcatattttatcgtttttcgtttacttaaaaatacataaaaaatttcgactcgtttatggcgtccgaaacgagaaaccctagtagacagcggtaaatgctcgattgatccaataatcaacgtcctcgcaagtatctacatgtactgcagcacacgacacaatttcttgtgcgtcctccccattacgagaagacctactccttattccatgagtttgcgttaaagtctagatcccttagtagctgctcatgattaatctagacgctattctaacttgtctaacttctaaattccctcttgtttactctgcgcttattatttacacaaattcatttcaccactatccaaacaagcgcatttactcgattgaccaattttttacgttaccaatcgttaaaacctaccccgtcactccacgaagggaattgttgatagatcaagtctactccttatttttctagtgactctaagttcctttagaagtctcgacaatattttcaagcaagcgaaaaacgataaaatacaagttatgagaatgatcaattcagctgatcaaacgccccatcccttttgcggtacaacgcaagactccattttttcttcgaccaatcagtacaccgttttggtcataaacatgtttgattgttggatatagctcttttaaggggataggatcttttaaaattatttgcttttgtttcccaatgtaataaatcatttcctctgagactttgtctttctggattatatatttcttacactgcacaacggttttactttggccagttgatagtttcttcgtgattttctctgtagcggtacaccgtttaccgtagtgacaaatatctttgagactcaaaattcctgtatatgacataaaataaaccacccaatttctttaaatatttttaacaagtttttcttgttatttttcaaaaatagagaattgattttcgttcatgacaaacaaaaaagagggaacgcatccaaacatgcgttccctctaatttcagcgttcgtcatacggcaaagagccacacggacatttttataacattatgcttaggcatagattcatcgtaatatcacgtatttttaaccttaacacagccaaaaaaagtggtatcacttttgaatatctgttatactaaatccgttgcgggtaataccgtaacactgaaaggttaacgcattaagggccaaatcttaatgccgtgtatgaacgctgacgaagattaccagccttccgagttcataccgcctttcttttttttgtattttcaattgtccaaatttatcgtccaaaagtgcagaacgaaaatcaattcatcacaggcatagcagacaattaaatttaaaacaactaaatttatacaaaaaaatgtaagcgaataatattcgtattgcctgaaaagaagtaatatcaagatttttagcttgtttaaataatgaaattatctctcttcacgtattattataactcaaaaaaaaggagtatgcaaacatacgttcccttttttatatttgaaattaattatttcttttaacacttatgacgtaaaaggctacgtttgtgatttttatcataatattttaacttataaattctattaaaatagctattattttgtaatattcgtaatataattagaataataaaaaatttttaattttaatgttactccatgaagcaacaatcactttgtcagtaaagtttcactctaaccagtctttcgtaatagtgcttggggagctttcagaattcaaacgtttttcacttgatactttagcagctattggtttttcgataaaccaattttttacatagacaaaaatcaggttctggatattttcaactttttcggtttttaatttttgataggcttttaacagtgtcgtgtataattcttgttctgcattgacataataactatcgagttcttcaaaaattattgaaataccactttctgtttcggcttttttctttgcattatgaatagtctggacagttttttgagcttcactgtaacttgaagaaaatgtttttattaaatttaatactcgttcagggataaacgtagcaatactgtcgtttttcataattttctcaaaattgtctaacaacaattgatcttgtaggcggtctttttcagtgtctatattgtgtctattagtgtctaatatattattattaagttctggtatgattttcataccctctgatttatcaacgttttggcacggtatgattttcataccctcttgagccccaagggattcagcgtctgatttttcgtcgggggtgggtatgattttcataccctctgatttatcaacgttttccctattttctctatcaaatttttcgagtaagtagatatcattttctgagacttttaattctgctagatacagtctattaggattatttttccctaactgtttgttaaatcccatctgcttttgtaataataaaccaaaggattccaactcttttttgattgctatcgctttttgtttttggcagtttaatacgctacatagttcatttgtcgtataagtaaaataaacattaccttcttcatcgatttgccgtttactgattgcgatctctaatcttgcttttaaaagcatataggcaatcttagttgaatctttcatttttttgtattcgtcagaaacaataaagacttttggaaattgataaaataattcgttgtaaactctatccgccttaaaaaaattaaaatcagccattgtagatcctctactttcacgttgttttatttatgtaaaattacctactcttttcgaaaatagcaaacttaaataaaaaatgcaaacgcattaaaactgttttttaattaaatactacctaaaatcagaaataaaataaattatgtactacctttaaagtcattaagaactactttaaataaatattatttataattaaatactaccagaagaacgtagaataaaatttagttttaaaattaaacataattaagtactaccagtgttaaaacaaaaaataaattaaaaatagaggagaacatcattcgtcaatgatgttcccctctaatcttagtatgtttttttgtacgaataccgagaaactggcttttgaataccgtggagtgaagcggtcaccacaagacttttatctcttcattagtttaatcgcttacatcgcagcggttttatgctgtgaaaagttgacggaataatctttagaaagaataaaaaaatcttaagataacaacttttttaggaaattttcatttttcaggagcaaaataagaaaaaatgtgaatagagagaagtgatatacgtgacacaacttaaaaaattgtgccaaaatcgtttagcaatcgttttgacagctgttttctttttctggctgaagacgatcattgcctactatgcagatttttcattaggtgtggaaggtacgatccagtactttatcttgtggatcaacccaattgcgactaccttattgttttttggcctttctttgtatattaaaaagccaaagccagcgttagctattcttttgatcattgatattttaaatacgcttttgttgtacttgaatattattttttatcgggaattcacagatttcattacagtcaaatctgtattaggcttttcgaaagtgtcgcaaggattgtcaggaagctccttttctttgatgaagccccatgatgtcatctactggctggatatcgctgtgttcattgggctactggtttggttgaaggtcaagaaaatacctatcaaaagtcaacctgtcggcaaaccgatggctatcgctgttacctgtctttcagggcttattttttcaggaaatctagcgctgagcgaagccaaccgtccacaattgctgcagcgaacatttgaccgttcatatattgtcaaatatctaggaatcgatgcgtatactatttatgacggaatcaaaacaggaatgactagcagtgttcgcgcgcatgcaagcagtaatgggattgatgaagttttagattatacaaagaaacattatgcagagccaaatcccgaaacatttgggatcgctaaagggaaaaatgtgatcgttctccatttagaaagtttccagcagtttttgattaatatgaaggtagacggacaagaagtcacaccgtttttaaatagtattttccagaatcaagcaacgatcagctttgacaatttctttcacgaagtaggacagggaaagacaagtgatgctgaaaatatgttggaaactggcacatttggtttacctcaaggctcattattcacagagcttgggtcagacaatgtctttcaagccgcaccagcgatccttggacaaaagcaaggctatacaagcgctgttttccatgggaatgtagctagtttttggaatagagatcatgtatataaaaacttaggttatgacaatttctttgatcgatcttattttgatgaatccgacgaaacgttaggttatgggatattagataaagatttattcagagaatctgcccaatatcttgagcatctacaacagccgttttacacgaaatttctttccgtaaccaaccacacgccttattatacggatgacaagaatttcgactttccatctttgaatactggcaatagcacagtagataattatgttcgaacggcacattatctggatcaatcattggaacaattttttacgtatttgaaaaaatccggtatttaccaaaattcgatctttgtgatttatggggatcattttggcatctcaaatacagataataaagacttagcaagtgctcttggaaaagacccagatacatggaatgaatttgacaacgcacaaatgcagcgtgtgccattaatgattcatatgcctggttatactaaagggtcagtcaatcacgaatacggtggagaaatcgatgttttgccgacattacttcatctcttgggaatcgatgataaagattatcttcattttggtacagacttattatcttctcagcatgatcaagtagttgcttttcgaaatgggaactttgtgacacccaaatacaccgtcctaggaggaaaagcttacaataatcagacaggagaaatcatcgatacgaaagcagcaggaatcgatgaggaaatctccaaagatcaggaaaaagtcaagactgcgttaagtctttcagataagctgaatcaggaaaatctcttgcggttttatgtgccaaacggatttgagacgattgatccgaaaaaatatgactataaaaatgaagcggaacgtaatgaagcaatcgaaaagcaaaaaggcgaacattcgacaagtgtcttttcaaaaaatggcaataaaacaacaaccaacttatatccagtaacaagaacagacgttgaacagcaaaaagataatcaataaacaatcaaaccaaccttcagtagttagacaacattctaatgcttgaaggttggtattttttatgaaaaaaacatttttttatttttttcgtgtatttttcctttttaacgtatctatttattgaatgcggaaaaatttaaattaaaaaggagaactattatgtatgatggtgaattgatcaagaaacttcgagtcaacaagaagttgacacagtcccaattagcggaaggaatctgttctaagacttctctagtcgggattgagacaaattcagtgaaaaaaatgtcatttgtaacattgagatcatttttagagcgaatgaacatgacacttgcagaatatgaatggatgcgaaaccagctggatgaaccaataaagttaaagaaaaaaagacgaatgctagatcgggtacaagaagacagctttgatccttataaagagatcagcaataaccgtaggcattttaagaaaacagaagatctgtattatttggttttgaatcttcacatggtcgaaaaaacagaagtatctgagacagaatttgaatttttacgttatgaatgccgaatcattgaagaatacttgatgcagataccagactatggtcaatttgaactatctattctagctgattttccttggatattcagtgatcggttcattgagaacaattatttgaaaatcaaaaaaagaatgcgacgattagcacagttgaacaatcatgagcagtatctctttacttttttaatgaacctgacttcgttttatatagaaaatggtcggttgaaaaaggcacgtagtgtgaaggaagatatgaaacggagcttagcacataaagaaagaagtacagtgatctatgaaacattgatggcagattattatcaaagattgatttctgctgctttaggggaagaaaagacgaaagactaccaagaattcttcacagtgctcgaatatatgttaggaaagaatcaacggaggtccttagagaaaaaactgctggccattgctgaacccagcaactagaccagcagtttagaatttgtatcacttcgccgctttttcagacggtttgtttatatcgaatggcgggaaaaagcgggcgatctcttttaccgcagcatcacgggaatcagaagcgtgaataatgttttcagtccccggcagcgcgtagtctcctcggatcgtacctggaacagcatcggcagcttttgttgctccaaccatcttacggacgatatcgatcacttcctcgccgaccaggacaagataaacgacaggaccggaagtcatgtaatcgatcagttcatcaaaaaaactgcgctcagtcaagtgctgataatgttcttttgctaattcaggagtcatagtttcaaacttcatttcagcaatggccagtccctttgcttcaaaacgttggatgatgcttccgactaaatggcgtctcacgccgtctggcttgataataacaagtgttctttccataacagcacctcgtttcctactatatttctattatagcgggaggtggaaaatgagacaaataaaaccgcgtgagacaggaatataacgcgtgtattttaaaaaaagtatgaaaaacatggaaaattgatttgacatcctcttttttagttgttatattaacgaaggaaaaccgaataagatttgttaggtgaggctcctatacaaacataggctactgcccaaaaacgtcgagagacgccaatgggtagaacaggaattgtcgagataaggcttttcataaggtagctaaaagcaggtatctgctttttacgttgtacagtgtcaaaactcaacgatgagatctgagaagctttttttaatatgctttttcaaacctttcgctgagtatttggcgagaggtttttttgttgccgcaaatccccatcggtgaaaaataaaaaggaggtggtctaattgggaaaataactattcgaaaaatgattggaagtcatgaattaaaattacttagtaaaggagatgagaacaaatggatgacagtcattcgaaaaacaaggatctagaggaaaggccagggctattatctatctgttctcagcccctttcagttttttctctatcgatccgatgaatagctaaagaccaaaagcagcgagaacagctgtcttttggacacaaaggagagattgagatggaaaaaaagaaagatacacaaaaaatctatgcagcttttgctggaaaaacgaaacaagaattatttgaactattccatgcatcagcaaatggattgacagaagaacaaatcgaacgttcaagagaaaattacggtgaaaatgcgatttcatatggcaaaaaaacaccattcatcgtagaaatattgaaagcatacatcacgccatttacattagtgttgatcgcattaggaattatttcattcatcacggaatatgtattagcagctcctggagataaagatcttttcggtgtagccattatcttcactatggttatcgtcagcgggacaatgacgttgattcagtccgtacgttccaatcaagcggctgaaaaactgaaatcacttgtgaaagtaacggcagctgtaaaacgtaatggaaagtacacagagattcctatggaagaaatcgtctgtggagatcttgttcggctttcagcaggggatatgataccagcggatatgcgtttattgtccgcaaaggatttattcatttcccaagcagcattgacaggggaaagctatccagtagaaaagcatgcgaaagtatgtgaagacgatcagcaaagcgaaacaagttacgaaaatcttgtctttatgggaagtaatgtcatcagtggaagtgcggaaggaatcattgtttctgttggaaatgaaacactatttggtcatgtagcagaaacgctatctgaaaaaccaattcaatcaagctttgaattaggcatccataaaacatccatgctactaatcaaatttatgtcattgatggctccagcagttatcgtcatcaatgggcttacaaaaggggattggctagaagcttttctttttggactatctgtagcagttggtctaacacctgaaatgcttccaatgatcgttacgacgaatttggtcaaaggagcaagtgtgatggccaaaaaaggaacagtgatcaaaaatttgaatgccatccaaaactttggtgcaatcgatgtgttatgcacggataaaacggggacattgacacaagataaaatcattcttgaatatcatatggattgtgaaggaaatgaagatgatcgtgttttgcgccatgcgtatctaaatagctactatcaaacagggctgaaaaatttgttagatgtggctatcattgatgaagcaacagaaactttagatacagataagatcaattatcaaaaagtggatgaaattccttttgattttgaacgtcgtcgtatgagtgttgtggttgctgatccagctggtaaaacacaaatgatcacaaaaggcgcgattgaagaaatgctgaacatttctaaatttattgatcttggcggtactgtcacaccattaacaaaagaacgaaaagaagccgtacttgcaaaagtacagtcacttaatgaagatggcttacgagtgattggtgtcgcacaaaagaccaatccaagcgtcgttggagaattttcagtcaaagatgagtcagacatggttttgattggttatcttgctttccttgatccaccaaaagaaacaacgaaacaagcgttgaaagctctgaaagaacatggtgtagctgtaaaagttctgactggggacaacgaattagttacacgttcagtgtgccgtcaagtaggtctagagatcaatgaattggttaccggtgagaaaatctcggaaatgagtgatcatgaattagcacaagtagctgaagaccatgaagtattcgtaaaattgaatcctcagcaaaaagcacgtttgacgacagctttacgtaaaaatggtcatactgtcggatttttaggagatggtatcaatgacgctcctgcaatgaaagtggctgatatcggtatttctgtagatacagctgtggatattgcgaaagaatctgcagacgtgatccttttagaaaaagatttgacgattttggaaagaggccttctttctggacgagaaacttttgggaatatcatgaaatatatcaaggctacagcaagttctaattttggcaatatgttttccgtgctgattgcaagtacgttcctgccatttttaccaatgctgcctttacaacttttgtttttgaatctgatctatgatgtttcctgcatttccttgccatgggatcggatggataaagaatatttggacgagccaaaaaaatggaatgcatctagtattgggaaattcatggtttactttggcccaacaagttcgatatttgatattactacttacttgttgatgtattttgttatttgtcctgctgtagtgggcggaagtttccatacattggatagttcacagcaagtgattttcatcgcattattccatgcaggatggtttgtcgaatcactatggacacaaaccttagtgctccatgcactgcgtacaccgaaagtaccatttatccaaagcaacgcaacatttgccatgtttgttatcactacattaggaattattgtcggttctgtccttccttttacaagttttggtgctgaattaggcttgatgccacttcctggcaattactggttatggttatttgctacagtcatcgcttatctggcgcttgtgacagctgtgaagaaaatctatatccgtcgattccaagaactcttataaacgagaaggctggttctttgcttctgttctttttggaccagtcgtgctaaactatgtgtattgttttggaaaggattaatgtatagatgaaaggtgcaatatttgatttagatggtttgttagttgacacagaaaaaacgtatcgtgatggctggctttggggatttcagcaatttgatatccatatcccaaaagaaatcgttgacgcttggggcggaaaaaactggaaacaaagttttgatattttagtgaaagcagcaggtagccctgaaaaagtacaggaagtccgtgcgaagcgtgaagaatatttttatcaacagctgacaagcggagccatccacttaaaaccatatgcaaaagaaatattggcagacttaaaagaacgtcatatgaaactaggcattgctacgaccactgttacgaaaagagcaacagatatcttggatcactttaaattagctgattactttgacacgtttacattcggagacgaagtgtcggagaacaagccttcaccgattccttatctgacagctttggaacgaacaggattagaagctagttcagcctttgcagtggaagattctttagtaggagcaacagctgcttcacgagcaggattaggcgttgttttgatacctgattccagttttgttcgaaattataccgtcgaagaaaaggaaaaattgaaacttcttgcggaaggaaaagatcttcgaactgttattgaaatgttagataaaaaaacagaaaaataaatatagaaaaaataatttgaatttcgtgcttgactttttagttttcctcatgtagattaatcccaacaacaaaatatcgatttcgttgaaaaggaaagtaagtttggaaactttgcagagaggctctggctggtgagaagagtcaagtaagaaaagctgaaaatggccttggagaataatttgtcgataagtaggcaaattcggaactgttcgaccgttaaaacgaacgccaatctctctttttgagatgttgggcttgagggaaggaaacttccgaaaaaaggtggtaccgcgatacgtcgtccttttactgacatagtttatgttagtaaaaggattttttttttgaatattatttgcattgaaatggtaagtacgatagaagaacctttgacagagagcttcggtagctgagaagaagcaaggaacgactattggaaaatggccatcgagcaattcatcccgagcatagatgtaaggcgatgacggctgcgaccgatatcttgctagagtatgatcgtacttgaagaggagttgtgtgtgaacacagcttgaacatgaggtggtaacacgcaaaaaagcgtcctcaagaaaatgacattttcattttcttgaggacgctttttttagataaggaggaattttaatgattgaattgcgagatgtttctgtatgtttcaaacaaaaagaaaaagagatacaggcagtagattctgtagatttaacgattgaaaaaggcgatgtttatggaatcgtcggttactcaggtgcagggaaaagtacgttagttcgtgtgatgaatttgctgcagaaaccaacagcaggagaagtcattgtcaatcagacgaatttgagtcagctctctcccaaagaattgcgaaaagaaagaaaggccatcggtatgatctttcagcatttcaatctaatggaaagccgaactatttttgacaacgttgatttttctttaaagtattctggaaaatcgaaacaggaacgtcgtcaaaaagtgaatgaactactggaacttgtcggtttggaagaaaaagcatctgcttatcctaaacaactgtcggggggacaaaaacaacgagtagcaatcgcacgagctttggcgaatgaacctaaggtattattatgtgatgaagcaaccagtgcacttgatccgaaaacgacccttcagatccttgcattgttaaaaaaattgaatcgccagttaggtttaacaatcgtcctgatcactcatgagatgcaagttgtcaaagaaatctgcaacaaggtagcggttatggaagatggaagaatcattgaaaaaggtagcagcatccagatcttcagcaatcctgaagaagaattgaccaaagattttattcgaacagctactcatcttgaccaagcattagaaacgatcattgcccattctgcttttgccgatcagatcgccaataaatggctggtggaattaagttatattggaaatcagacgaacgaacctctaatcgctcatctgtacagcaaatatcaagtaacagcgaatattttatatggcaatgtagagttattacaagaaacgccgttagggagtttgatcgttactttagctggagaaaccaaacagcggcaaaaagcattggattatttgatcaaatctggtgtaaaaataaatattttacaaaaaaacgaattagatagtcgtatcaaagtgatcgaaggaggaagataaaatgactgatttctttaaaacatatttgcccaatgtttatttgattccggatgaatttgtcgaagcgacgaagcaaacactatatatgtctttttggacagcattcattggcgggatgatcggaatcatcttaggtgtgacgttagtagtgacacgccctaatggattactagctaaccgtctgctatttgaaatacttgataagctgatcaatatcattcgttccatccctttcattatcttgctttctcttttagcattgactactcgtttcttagttggaacgacgattggtgcgaaagcagctttagtgccattgatttttggagttgttccgttttttgctcgtcaaatcgagaacgcactgctagaagttgatcctggggtgatcgaagcggcagaagcgatgggaaccagtccaatcggtattattttacgtgtgtatttggtagaaggtttgcctggtatcattcgggtctcggcgttgactatcatcaacgtgatcggactgactaccatggctggagcagtaggtgcaggcggattagggaatcttgctatatcgagagggtataatcgattccaaacagatgtaacgattgtggctacattattgattctaatcttagtttttttaagtcaatttatcagtaatcaactgattaaaaaaattacacattgaaagtggaggagaaaaaatgaaaaaaattattcgttttgtagtcattgcatttgtagcaattatttggttggcagggtgtagccaaggaaaagcagatacaactgacaaaaaagaaactaccgtaaaactagggattattggagaagatacagatgtatgggacaacgtgaaagaccgtttgaaaaaggagaacattaatttggaatacgtgaaatttacagattacaatcaaccaaatgcggctttagcagatggatcgattgatttgaattctttccaacatcaattctttttagacaattacaataaagaacacggaactgatttagtatcgatcggaaatactgtcaatgcaccgctgggaatttattctaacactttgaaggatgtagctgatatcaaagacggagcaaaagtagcaatccctaatgatgttacaaatggcggcagagctcttctgttattgcaaactgctggattgatcaaagtggataaggcaaaaggacaagcgcccactgtttctgatattaccgagaatagaaaaaatctagacatttctgaattagatgcttcccaaacagcacgtgctttgtcagatgtagacatttcagtgatcaatagcggtgtagctgtagatgctggatttaatcctgcttctgatgccatcttcttagaaccagtggatgaccatgcacgtccttatgtgaatatcatcgttgcaagaaaagaagatgaaaacaataaaacgtatcaaaaaatagtagacgcttatcaaacagaagacacagtcaaagtaatcgagaaaacatcaaaaggatcaagcgtgcctgcatgggaaacattcgggagaaaataagaaaaatgactagcataggaggaattttttatgacaacaacaatctcaacaaaccaattgaaggatctaatccaatatcgtttaccagaatatcaagcacttgctctagatatccacgaacatcctgaagtaagtaactatgagttttattcctcagcagcgttgattaaacaattagaaaaagaagggttttgggtagaaaaagaagtagctggacaccgaacagcctttgatgcacgttatatttccaataaacccggtcccacaattgcctttttggcagaattcgatgctttaccaggtattggtcatgcatgcgggcataatttgtttggtacttactccgtattagccgccagcatagtgaagcaatttattgatgaaactggtggagaaatccgtgtatatggcaccccaggggaagaagggggcgagaacggatcagctaaaggcagctttgttcgagaaggtttttttgaggatgtcgatgtagcattatgcgtccatccagcttttcgttatgggaaaacgacagaatctttagcgaatgatccagtcgacatcaaattttacggtgtcgcttcccatgcagcagcagcacctgaaaaaggagtaaatgctttggaagcattgatccaagtgtttaatggaatcaactctctacgcttgcaattgccaaaagatgtcaatatccatgggatcattacagacggaggagtagctgccaacgtcattccagattacgctgctggacgtttctatttacgtgcaggaaatcggcaaacattagataaagtatatgaaaaagtggaaaatatcgtacgaggtgctgcgataagtacgggcacgacttttgagtttggattgttccaaaatgcagttgatgatgtcatcgttactccttcttttgatgacttattcttccagcatgcaaaagaagcaggtgttccagatgaagaaatagaaacggaacaaagaacaagtctcggttcttctgatgtaggaaatgtcagccaagtcataccaacaatccagcctacggtagcaatctctgagacatatattgccggacacacagaagaattcaaagctgctgctaaaagtgacaaaggccttgcttctattgcgattgcagcagaactactcgccaatacaactcttgatctgttgaaagagccaaagctattagaaagaatcaagcaagaacatcaagaaatagtagcaagaaaaaaacaagagggtgctactttctagtaaaaaataaacttgtgtgtgaaagttataaaaataattttcagaaaaatgaaaaaatattttctttttcattgacaaatgatcttatggaaggtaaacttcatacaagtcaacttttcacgcagtagcggttaggtgttttgttcagaaagtcggtggtcgctgtgaaccgatcaagcctaattgacgaattacatggaaagtccatacatttgaataaaagtttgaaagtgaaaaacagatctgtttttaattaaggtggtaccgcggagtcattcgtccttagtttaaaacaggtctttttatttttataaaggaggaatcgcggatgaattgcggcggagtaatccgatatcttaacttttttagaacataagaacaactaaaaaaggagagattatcatgggaaaaaaaggaacaccaagttttttagaagcaacacttgtattaatggttattgttttaggcattgcgattggcgttgtcggattaaaggtctcacctaatatcactatcttagcagcgatcggaatggtcatgttgtatgcagtgataaaaagatacccgacagattggctgcacgaaggaatcatcaatggcatcaaaccaggaatcatcccaatctttatttttattttagtcggttcattgattgctgtatggatacaagcagggatcattccaactctaatggtcattgggttcaaattgatcagtgtccagtggtttgtcccttctgtatttgttgtgtgtgcaatcgtaggtagcgctgtagggagtgcctttactgttatgtcaacgattgggattgcatttttcggtattgggacaacactaggcctaaatccagcgctggttgttggagctattgtttcaggtgccgtttttggagataagatgtctccattatccgaatcaacaaatctagcagcagctattgttgatgccgatttgttcaaacacatcaagcatatgatgtggtcaactgttccggcatttgttgtttctttctttttattcatgattttaggacacacaagtaaagccgcaagtctttcatctattcgtgaagtgactgatgttctagaagcaaactttactatttcaatctggtcactgattcctttatttttaatgttactgtgtgcatggaaaaaggtgccggcaattttgacgattttgttgaatatcgctgtagcagtaggaatgatttttattcaaaacccacaaacttccttaacgaagttggctggggtcatcgaatcagggtttgtttcaaatactggaaaccaacaaatcgattcactgcttagccgcggaggaatcgaaagtatgatgcctactgtgtcattgattattctaactttgtcattaggtggattgttgatcgaatttggcttgatctcaaccgtgatggaacgagtatcaagaaagatgacgaacacaccaaaattgatttttacaacattgatgacaagtatcggagtaaatatttttattggtgaacaattcctatctgttattctgcctggtaatgcatttaaagaaacttatgaaaaagcaggatttgatccaactgtattaggtagaacgctagaagatggtggaacagtaatcaactacttagtgccttggggaattgccggaagtttcgtagcaagtacatttggtattcctacactcacttacttgccattcgtatttttcagtttgctttctcctgtgttttcgatggtcagtgccttcacaggttggggaatctcaaaaaaatttgtgaaaccgcaagaagcagtaagcaagacagcgcaattagaacaataaaaacataaaaagggattgtgacaagacttttgtcacaatccctttttacgaataaacggtattcaaaagccagtttctcggtattaagccaaatttatgcaaaaatgtggaaagtcattttcacaaaatttttcttaatacgcgaaactaagcgactttttcacaacctctcgataaacggtgttcaaaagcttgcatctgcggtaataagcctaaccaaacgaaaaataggagaagctatttttcgtttggctgttcttattacttgatgcagggcagctttttcacaaccccttattcacggtgttccagaagtagcttcttcttatttcttgaagctgatcacttctggaacatcctctttttttatttggacggataatggtcattccatttctttgatcatttttttcattttgtcgatctcttcttcttgtgcctgaatgatttcttccgctaatttttttacttcaggatcttttaaatcagctcgtttacttgtcaggatagcgatagaatgatgaggaatcatggccttcatccaagctgtgtcgttgacagtagtttggcttcgtaccataaacaaggaaccggcaaaaacaagaagactagcggctaagatcataacatttatctttttgttttcatacattttccacatgaacaacagcatgatgactgccatgactgcacccatcatcaacgccatgaatactcgtgtacgactgaagaagatatgatcgagcgcatagacattcaagtacatcataccaaacataactaccgttgaaacaccgatcatcaacaaaaacttccaatactttttcatttaaaacaaactcctttttttcattcctttcttctatcatgtcatgagcgtggagaacaatcaattaatctgcacagatggtttttgaacaccgtttatcaagaggtcgtgagcctgccgtttaacgctgagtcacaaggaacaatttcaaaaaacagcttctcatgtttgttgaatattgtgacttgtgaccgaggagttggcaggagaacaccgtttagtggagaggttgtgaaaaagctgttctgcatcaagtaataagaacagccaagtaaaaacagcttcttatgtttttaacttggctggacttattaccgcagatgtaagtttttgaacaccgtttatttggaaaaaggaactgcaacaatttttgtcgcagctcctttttttcaatagctccagctattcaatataaataaaataaaattttctatcgatttcattcattcgtcaatacgaacacatcattctttttttgataactgaaataaatgaacaggtaaagcaggccagtcaatacagttaccccaatggagttcgtgaacaggataccaaggaaaatcaatcctaagacagctaatgcaaaaaagctgattcctttatcccataatgttccttttcttagtgccagtacaaaggatgccgcgctgataatgatccagatcaataatactgtatacgaaagggaacctgccagatagccaaataatttgtcaccgacaaaataagaaagagctacgccaagataaagaacactggtacaaaataaaacagcacgttgcggtacttgatgcttgtttaaaacagctagttttctagaagaaccttttcgatccttcaaacgaaagaacaaaattctcgaagatgcatacacacccgaattgatagatgagaacaaagcaaggacaatcacaaaattgacgatatccgctgcaaatgggatattcattttttcaaataccatcacaaaaggactgacattcgtacctgctaaagtattccaaggaaaaagaatcaaaagcaaaaacaaaggaatgatgtaaaaggaaatgattcttcccatgacacctttgatggctttaggaatcgcacgtttaggatcatctgcttcgcttaccgtgatagcaatcagttcagaaccgccgtaagaatagataactacaagcaaagaactgatgattcccttcataccatgaggagtaaacccaccatggtcagtcaattgctgaagggtagggaaaacgcctgtgcccaacatttgctgaccgacaagataagtagcaaaaatgatcagtaagataatgacactgattttagcaaaagccagccaatattctgtttctgcgaataaccgtaccgaataaagattgatgatcgtagtcaaaacagccaacataaaaacaaatacccaggctggaatgtgcgggaaccacaactgcaaaaaggaagcagctgcaacagcttcagcgatgatattgataatccacatagaccagtagacccaatcagtaaaatcagcagaatgagcacctagataagggcgtatcaaaccagataatccgtgatgcgtgtcgccaccgcttaaaacgatttttcccagacctttcatcacgatatataaaatcagtccaccaatcaaaaaagcaatcaatacagaagggccggcgatcccaatcgcttcgccacttcctttaaatagacctgcaccgattgctccacctaaagctaacatggtgatatgtctggagctaagttgttttttcaattttttatcttccataaatgacctctttcttttaaattcacaatcaaaatttatattaagaataaatagcaatatttaacaatgactaatgataacaaattttcagacaattacaactattcagaaaacttttaggcgaattttaatagaagaatgatttatttcatcatattttcatacaaatgttaaattttcatataaatataggaagcgttttactggctttttactatttaaacaggctatcataggaaaaagtgacagagaaagtgaggcggaaaagatgaacaaaaatgacgtactgctagttacaaaaaataaatcactttattttttgccctccatccgctctttagatgtttggtccggaaaagatttactacagtcggaattcattaaatcagctagacaacagttggcaaattatcagctgatcgtttttttagattatggatttgatatggagatggctcgacgcgtgcgcccatttaccaatgcaaaaattgtgttatttttttggaatcacttcaaagcagaacacgaagcgatgctgaagcaggcacaagatgaaccggcaatcgatgagatttatcattttgattttttggaagcaaaagaacttgggctgaaacataatagttcattttattcgaaacatatgaatttttcttctagcgaaccaaagacggatctattttttggtgcaacgaataatgggagaaaagaacgagcagaaagctataagcaggaatttataaaaagagatgttacgaccaactatttcattcttccacatcgagggaatgaacaacctggatatcttacttatgaagagtacctgaaaaaaacaggggaatcgcgcgggattctggaactgttgcgggagggtcagcaaggagtgactttgcggacatttgaatctatgtattttcaaaagaaactagtgacggataatcaagcgattgctcattatcatttttatcgtcctgaaaatatttttttgcttcgagaacgtgatttagatgaattaccggaatttctgcatacaccttttaagccaatcccatcagagctattggaattttatgatgcagaaaattgggcaaaacgatttatcactaacgattccactatttatgagcaatacgaatatgacctctcctctgttgaaaataaataaaaaacctacattttgaagagattatgtaccgaaacaaacaagcacaattcttatggcatcatgagagttgtgttttctttttgatctttcattgggcttaaaaaaagagaaccagctgctgattcagctgattctcatcagagagccttttactctgcgccaaggattccttcttttgcatggactaattgggtcaaaaaggcacaatatggtgtagcaatatcatatttttgtccttttcgccaaacggcaccattgatgtagtcgatttcagtcaaacgatggtttttgatcaggtcttggtacatagatgggtaatgcaacccgatgttgtcaggatcataagtagaagcaatatgttggtacacttcttcttgatctagtatgattccttcttttgctgcgatagaagcaaattcagatacgattgttcgaaccatgctctctgtcgctttttgcgcgcctagttcagcaatattacaatccaaaatcgtgcataaaccattcaatgttccatttacacaagcttttcgccaaatggaataacgaacattatggctatagatcggatttaattttgcttcttgaaagacttctacaactttttttgtaaatgcttcgccttctggttccaagttctctagttcgatttctccatcacctaacaatgtgacttttccgggaccagctagaccagctgtccacatcgtgatcccaaatatgatatttttctttggcacatatttttccagtacatcttcatgacctaatccatttagtaaacacaaaacataagtattgtcagtaataatggattggatcgaacgaaacatatcatctaattgattcgcctttgttaatgctacgatcaagtccacgtgttcgttgctttcgatgatttcttctggtgaatagattggcagttttgcgaccacttctttaccgttaaagtcagcaatcaacccatttgtacgaatggcttcaatgtgagcaggccaacgatcgatcaagaggacctcatttccgctttgatgtagcatcaatccgattcggctgcccattgctccggctccagctattgcgattttcatgttttttctctcctttatcaatgagttcccttttagtatatagaaaaatggaagaaaatagcattgttttgtttgaaaaaaatgaaaaaaagtgtcttacttaagaagaaagtgagggatacagatggatattttggcggcaattgattcatttaaaggaagtgcttcttcatttgaactaaatcaggcagttctaaatggctgggaagatcgtaaaggaagaaaaatcaatgtgccgattgcagatggcggagaaaatactgcagaagcaatctattacgcgctcgggggaacatggcgtaccattgatgggatggatctcttattccgtcagcgaaaaatcagctatttattgacaacttggcaaggaaaaaataccgcagtcatcgaatctgcacaagcattggggttagatctacttgataaaccaacggatcaaactatccgacttgcttccagttatgccttaggagaacttatcaaagatgcactgcttcaagaagtagaacaaattattgtcactttaggaggaagcgggtgtagcgatggtggtctaggattactccaatccttgggtgcttctttagaagggtacacagaaggaaatcctttattatctactaaaaaacttcattttgatcgaagaaacgttcttgtttctaaagtaaaattgattatcgctgcagatgttaccaatccatatacaggtcaacaaggagctgcttggcaatttggaagacaaaaaggaggaatagatacgacgctagctttcttagataaacaagcaggaaagattgctcagcaaataaaagatttctgggaggtggatttagatgatattccaggaagtggagcagcaggcggtattggtggagccctttttttgttgggagcgaagatggtttctggtttcgatttagtcagccaaatcactggattggaaaaaaagatcgaacaagcagatgtcatcattacaggagaagggcggatcgatcagcaaacgatccacggaaaagttccatacggtgtagcagtgcttgcaaaaaaatatcgaaaaccaatcatcgctatttgcggaagtagagaccaagagctagaaggactctctgattttctcccaattgtcttaagtattcatttgggtccaataggtttagaagaagcaatggaacacaggcaaacattagaaaaaacaaaaatcttaggacagacacttagcagatttttcaccatcctcccgaagtagttgacaaaatcattttctttatgctatcgtaatttcaaatataggacaaagtgagggatccgtgcattgaaaaattaagtcgattgatgaaagctgcattcagactgtaccttgtggagacaagggagcagtgtgcagattttcgggattggcttggttttttcgatgtatgggtctttttgtgtgtacccaacccttgcatcctctttagccagttctgaaaataggactggtctttttttacgaggtgatggaaaatgtctaaaatcgaaataaaaaatctgacattcggctacgacagccaaggcacattattatttgaacaagcaaatctaaattttgacacacaatggaaactaggacttatcggacgaaacggtcgaggaaagacaactttactgaatattctacaaaacaaactaccttatcaagggcaagtaatccatcagcaagaatttgtctatttcccgcaacagacaaaagataaagaacgtttaacctattacgtgttaaatgatattacggattttgagatatgggaaatcgaaagagagctccaattgatacaaacagatcctgaaatcttatggagagaattcagcacactatcggggggagagaagacaaaagtcctactggcacttttatttgtggatgacactcatttcccgttaatcgatgaaccaacgaatcatttggacatctctggtagaaaacaagtagcggcttatttgaaaaagaaaaaacaaggcttcatcgtggtcagccatgaccggggatttatcgatgaagtagtggaccatgttttagcaatcgaaaaaagtcaactggaactttatcaagggaatttctctatctatgaagaacagaaaaaacttcgtgatgaatttgaaatggctcaaaatgaaaaattgaaaaaagaagtcagtaggctaaagaaaacagcagctgaaaaagccgaatggtctcgttcccgagaaggagataaaacaaagaaacaagtcggattcatcgatactgaatctagacgagtgaataaaggagcagtgggtgctgatgctgcacggacgatgaaacgatccaaagcaatcgtgaatcggatggagacccagatcagcgagaaagaaaaactattaaaagatatcgaatatatcgattctttgacgatgaatagccaagcgtctcaccataagcgacttttaagcgtagaagatcttcaattagggtatgaaaatctgttattcgagccaattcattttacaatcgagcctcatcagcgggtggcgatttcaggtcctaacggtgcaggaaagtcatccattatccattatcttctgggggcattcaacggcaaggttataggagaaaaatcccagccaaaacatctgagcattagttatgtacgccaaaattatgaagacaatcgaggaacgttggcggaatttgcagagaaaaaccaagtagactaccaagcatttttgaacaacctccgaaagcttgggatggaaagagatgtttttcataacaagattgagcagatgagtatgggccaacggaaaaaagtggaattggctaaatctttatcacagccagctgaactatatatatgggatgaaccattgaattatttggatgtcttcaatcaagaacaattagaacaactgatcttgaacgtgaaacctgccatgttactggtggaacatgatcaaaccttcctggataaagtatctactgagattatttctcttgagaaaatctaacccttgtaatctcaagaacaacaaggtatggttaaggggaactttgccaacgaaggagagaatcacatgctttatgtaacgagacacggagaaacaacttggaacgcacaaggattagtttgcggacgggcagatgtgccgctgactgaaaaaggacagatgcaggcacagaaactagcagaaaaggtagtagatttgcctgttccaatcacgaaaatcatccattcccctcttcaacgagcaagagatacagcacaagcagttgctgatcgtctcagcttgccgctgaccgttgatgaacgattggtagaaatggattttggggattatgatggactgccaagcaaagatgagaactttcaaaaagcacgtttagcattcgctgtacgattcccaaatggggagtcagtcttagatgtgtatgcacggatcgttcctttattgaaagaatgcattgaagacgaagaaaatgtctatctgttagtttgccataatgccttgataagagtgatcaatgcttattttcatccgatgcctaatgaggggttctttagattcatggtagataatacagaattggtttcttatgagtaattatgtgtttgtgttatttaaataaaatatttcaaggcactgcttttgcttagcagtgcctttttttaggttatgacaattcttttggtaatataaactcaacctttagaaatgaaatttaattattttaataaaagtgttgaaattttatttctttagatatatactctagtcatagaaatgaagacggatacagaaaaagagggataatatgtttggcttttcaatatttatgaacgattctttgtcagaagagaagaaacagtatatccgccaaatggcatccaatggctttgtcggtattttcacttccatgcatataccagaagatgatgtttcggcatatcaaaagcgattgatcgaactaggaagcgaagcgaaaaagaataaactagaattgatggtcgatatttcaggagaggcattggaacgagctggtttttcattagaagatctcacgcctttgaaagcaattggtgtaacaggtttaagaatggattatcatatttccaatcagcagattgccgactggtcacatcaattgaaaatcagtttgaatgctagcacgatcacgcctaaagatatcgatgaattgaaagaagcagaagctgatttctcacagattgaagcttggcataattattatccacgtcccgaaacagggctggacaaagaatggtatcagaaaaaaaatcaatggctcaaaattcaaggtctccttgtccaaggttttgtaccaggagatacagagttgagaggcccactatatcaaggattgccgactttggaagaacatcgcggggtccatcctcttgcaggcgctctagatctattagcaagtaacacggatattgtttacatcggagatgcaggtctgtcagaaaacgttcaggagcaatttgcttctttccaaaaagaacagacagtcttgctccatacggaacctgtagatgaagaattttacgaatatatattagggaagcatacgaatcggcaagacgatgcaagagatgtcatacgaagcgcagatgcacgttttcgagagattccgcctatcccagcaagaaatacagctacgcgtatgaaagggtctattactttagataacgaaaagtatttgcgctatatgggtgagatccaattaactaaatatgatttgccagcggatgaaaaagtgaatgtagtagccaaagttatcaaagaagagctaccattgatcaaccaaatcaaagctggtatgaactatcaatttataagaaaagaaggaagataaaaatgagcaaaatcaatttagagaacctaacaacggaacgcagaaaccaagaaacttttggattagatgagatgagtatttcacaagccgttcaactaatgaacaaagaagatcagaaagtggccgctgctgttgaaaaagaactgacaagtatcgaaccagtgattgctaacacgattgaatcctttaaaaaaggtggacgtctgatttatatgggagccggaacaagtggaagactaggtgtgttagatgctgctgaatgcgtaccgacattcggtgtagaaccggaaatggtcataggtctaattgctggtggagaagaagcaatgactgtagctgtcgaaggggccgaggattcttatgagctagggcaagaagatctaatcaagctgaatttgacaaaaaatgatatagttattggtatcgcagctagcggtcgtacaccatatgtgatcggtggattagattacgcaaaatcgatcggtgctgtcacaggaacgatttcttgcaataaacaagccgaaatcagtaaacacgcggatttcccaatcgaagtcgatgcaggtccagaatttttgacaggctctactcgattgaagtcaggaacagcacaaaaactgatcttgaatatgatttctactatcagtatgattggtataggtaaagtattcaataatttgatggtcgatgtcaaaccaacaaatgaaaaactaatcgaacgctcaaaacgaatcatcatgcaagcgacagaagctgattacgaaacagctgaaaagtactttgaagaagcagatcaaaatgttaagctggctatcgtcatgattttgacaaatagtgataaagaggaagctcaagcaaaattagctgaagcaaacggatttgtaaaagggaccttatgagggggaaaagaccatggcaaaaaacgaactgactttggaagaactggcaaaacaaatttataaaggggcaggcggcatgggcaatgtagaaagcattgtccactgcatgactcgtgtgcgtatgaagatcatcaatgatgatcttgtaaatgtctctgaattaaaagcgattccaggagtgcttggtgtagtagaagatgaacagcttcaagtcatcatcggacctgggaaagtgaacaaagtagcacagcaaatggttgatttggcaggcgtgaaattaggagaaaaacttccttctgtaagtgcagctacagcaaattcatcagcatctggaaaagaccgtgtaaacgaacgggcacaagaaatgaaaacggcacaaaaatcgaaacaaaaaccatctaaaatcaaatcggtattaaaagacatttctaatatctttgtgccaatgattcctgcatttgtcggtactgggatcgtggcagggattgccgcagttttagcaaacttagtcacagccggaacacttgatgcagcaacatggcaacaatatatcgatgtgatgaacatcttgaaaaacgggatgtttagctacctagttatctatacaggtatcaatgctgcacaagtttttggtgcaacaccaactcttggtggagttatcggggccgttgtgatgctgacagggatgaatccggaagcaccactgaaaaacttatttactggtgaagctcttgcagctggacaaggtgggatcttaggtgtcatcttcgctgtttggctattgtcaatcgttgagaaaaaactgcataaagtagtacctgatgcggtagatatcatcgttacaccaactctttcattgattgccatcggtctgattgaaattttcttcatcatgcctttagcaggtttcatttctgatggcatggtcggtgggatcaactgggtacttggcgttggtggagcatttgccggcttcgttctaggcacattattcttgccgatggttatgttcggactgcatcaaattttgactccaatccatgtgcaaatgattgatgaaactggtcgtacgctattgcttccaattcttgcgatggctggtgcaggacaagtgggtgcagcattggcattatggattcgctgcaaaaaagataaagaattaacagaaatgatcaaaggagctttaccagtcgggatcctaggaatcggcgaaccattgatttacggagtaacattacctctaggacgcccatttattactgcttgtatcggtggaggtatcggcggggcagtgatcggaatgatcggaaatgtcggggctatcgctattggaccttcaggagccgctttgatcccattgatctctgacggtaaatggttaggctacatccttggattattggcagcttatgctggtggcttcgttgctacattcttcttcggtattcctaaagaccgtttagaaaaagaagaattagcgactgaaacagccacagtaaatgaagtgcctgaaaaagcagtacctcaaacttcagctgaaagtgtgactatcctctcatcagttgctgacggaacagttgtttctttagataaagcaagtgatccagtttttgcacaaaagatgatgggtgaaggctactttgtagaaccagaaaacggacatatctattctccagttactggggtagtcagttctgtcttcccaacgaaacacgctattgggatcacaacgccaaatggtttagaaatcttgcttcatatgggaatcaacacagttgacttaggcggtacgccatttgatgtgaaagtaacagaagggcagcaagtgacacctgatacgcttgtagcagaagctgacttagaagcgatcaaagcagcaggcaaagaaacatccatgatcgtcttggtaaccaatatggatcgtgtaaaaaactttgtcttggaaaaaacaggtaaagcaaaagcaaaagcacatgtgatggatgtcaaagcttaatatgatagaaacaatagaaacgaaagaagaagctgaaatctatttttcagcttcttcttttttattatttattgttttctgctaaaatctgataaattcgtgtcacatcagatggtgttccccgtaattcataatctgccaagaaaggaaagccaaatgtttgtgcatattgtttggctgttaaacaatactgattattgaagtttttatttccgctaccgactacaccaagacaaagtttatgattgtcttcatgttccagatattcacgcatcgtttcggtcaagatttctgtatcaccgttatctaaaccatttccgccgtctaaataagtaggaacgaaagtaaaaaatggttctgtttctttcgtaaaatcactattttcatggatttcttttaaagtaacttcaggattcacaggatcttctgcatgcattttttcagcatattctgctagatgtttggcaaaggcacgcgtatttcctgaaatcgatatatataaaatgttcatggttcatcccccaattctttccttttagtatagcatcttttttaagttttttggtggtgtaatttggaaagggactaggcgctttgcttgtataatgagaaaaaagccggtagaattatatttctattaaagtttttattaattaagtaaaaataaaaaaggtttgttatactttttgataaaagcggttttattttggaggatgcttacatggatacagagcaacagaaaaaaggaattggtttaattccacttgctgccttagtaattggttcagcgattggaggtggcgtatttggtattatgacggacatctccggatcggctggcggcccagctattttcagttgggtactcgtaggaacagcaatgttgatgctctccttatcgatcaataatatcaataaaaaacgtccagatttaaaaggcgggatctttagttacgcagaagaaggttttggccgtttcgctggttttatcagcggttggggttactggctcacatgctggttaggcaacgtagcttttgcaacattgttgatgagcgcattaggatatttcttcccagtatttgaaggtgggcaaaatctggcatcgatcgtgatgagtacagtctttttatggggatatgcatggctagtgaatcggggagtcgaaaatgctagtttcgtcaatgctatcgtcacattctgtaaattagtgccattatttttatttattgtagtagctatcagcacgttttcgatccaacaattcattgataacttttctagcgacattatattgaatgcgaatggacagccgatcccgttttccagtcaagtattgagttgcatcatggtgatgctttgggtatttgttggtattgaaggagcctctgtcgtaggttcacgagcaaaaaaacaatcagatgttgggaaagcaacgattctagggatattcggcttgattattatttacgtcttggtttccatgcttccatatgggacaatgacgatgaatcagctgcaaacgatcaaggcgcagcctgctatgggctatgtgtttgaaatgatggttggtaaatggggagcagtcgtgatcaacggcggtttgatcatttctttagttggtgtttggctctcatggacgatcttaccgattgaaacaatgggaaacatggctgaagacggacttttgcctaaagcatggggaaaactcaacaaaaatggggcaccaacttatgctatcgtattgacgacgttatgtacgaatgtctttttactttcattattattcactgacagtgcttataactttgcttacacacttggtacagcagctattttcttcacgtggcttttcttaggattgtaccaaatgaaactttcttatcagcggaaagaatgggtccaatttttagtagggcttttagcaagtgcctttcaagtatgggctatgctagtcgtagcctttaatgaagtaatgcttgttcttgttcttttcttgccaggcatttatttttatctcaaagcacgtaaggagcaaaacgagcctgtacaacatatccacttagataagattttacttataggtgtgacgatggtcggagtgattgcaatggttttatttgccactgggatgcttcacgtatagaagtataaaagaagtataaagagaggttgtgagcctgtcgtttattcaaaaacatactaggaaaggagctgtgacaaaaatgttgtcacagctcctttttcagaataaacggtgtttaagagacagccaatcggcaataaggctgaacggctctttcacaacctcttttttgatgagtcatcatacattttttcgcttaaatacgagatatcctaatgctaagaacaaaacgatgtaagctaaattacccaacagcatttgattagtagaaagatgagtcaattgcttcatgatctcttcgtttccaatttggttttgcagattcaacatactgatcggattccatttgatccactcccatttttggatgagtgcgataaggataccagatatgattgacgaagcaaaataaaagacgattcctgctgagatggatgcaccggaactattgataaagcaagcaatcatcaacactaaacttaaaatcagccataaaccgatataactacccaaagtataagtgaacaagctttggatcagtgtttgaccagtagaaaccttctccgtgaaggaaatcgaagggaaaagaatcagtttcatcaacacagtgacaataatagctaaaaggtataaataaacagaataaataactaatgtgatccatttgcttactaatatttctcctcgagaatactttcgataaaggagatttttcaatgtaccatattgtgcttccatcgaaatgatcgtgcttgcagctgcaatcatgataaagacaatccaagatgtggcactaaaaagctgagcagtcatttcaactggatcaatgatcgtcgtatattttttggctagaagtgctgttcctatgagcaaaataactaatagaacagataaaacagcagttgactttttcttgatcaatttaaataattcttgttttacaagcaatgtcatttttcttcttccccctttactgaatccagaatttccaatagagaagattccaaatcattcgtcagatgctggacgtctgtcacatggatattttgtgcagacaataactggatcacggttcctaataattcttcgttttcttttaaaagcttgattttatcagaatcttccaaagtatatccagcttctgtcaagatcgttcgagcagctagatcattcgttgtagagataatgatgaaatcttgcgctgcttggttcaattcagccattgtacattgcttgatgatctttccttgattgatcaggatcagctcatccaccattttttcaagctcactgagtaagtgactggagatcaagaaagaggtgccttgagtagccaagtcggtaatgatttttcgcacatctcttgttgcttgtggatccaacccgttcatcggttcatctaaaataacgatagaaggatggttcagtaaggcaagagcaatccctagcttttgtttcattcccaacgagtaagatttcgcttttttgtgaatgtacttttccatcttgagctgattcacgatagtatcgatagcagatacatcgtttgtttcagagaataacttcagatgatcatagcctgttaagaatgggtagatacccggatattcgatcaatgctcctacttgttctaaccctttatgactagagggagaaatctcattttcaccaatacggattgttccatctgagtaatggatcagtcctaaaatagctttcatgatcgttgtttttccagcgccattaggacctactaatccaacgattttgccaggggataagctaaaactgacatcactgagggcttgtttgtgaccaaagttcttggataattcttggaccgaaagacttttcaaaaatattcactccttttctatagatagtaaaagcatacaccagatgagtggagaagtcgctaggtcattggacttatttcttattttttcataaaaaaattgaatattaaataaaaaggcttattttttctgatcagtacttattccaagtgtctagtggccgctagtaatcttgatgccaatgatactgatgagtagcatccccacaaagaaccaagtggaaagattcagcttatcatgaaacaagaccacaccaattatgaccgaaccaactgcgccaatccctgtccagataggataagagagactcatcggcaaacttttgattgcctttgataaaaagtaaaaactagcaatcattccaatcactgtgtaaaaaagaataattgattttagaaaaaccatcactccatttcatcatcgttgaccagaatacttccaaaattcctgctatgattaattccatccatgccatacatacgttcctccttcaatataaaaaatacacaaaaagaggagaaccatcccttcaaagacctaatggaatgatcatcctcttttttactacccggtggcagatcgtatatctttttctgtagtatagcacacctatccagatatcggcaatctcatactttttagtaaagtgtaccaagcattgacggatatatcgttagcagaaaagaagatgaatgctttgcaatttcatagaaaggagttgttatttattaatcatttaaaaaaaacagtaactagaccttatttctatatattatcgggcaataaactaaaaaaaactttaccttacaataagtaagataagttttgtgataaaaaaataacgaaaaatatttaaaaatagtgtctatttcgtgagaaaacaactatattttttatgtgttttgctttataattaaaaaaatattgtcattttatggaggaaaatatatggaaaattatcttagccttttaggcgtcttgattgttattctcgggtttgcatttaaattagactcgatattgatcgtaatggttgctttagttgtgacagctttgactggcggtcttggcattcaaggaatgttagaacttttaggcacaagttttgtgaacaatcgtgggatggcgattttcatcatcattatgttggcgacaggaacacttgaaagaaatggtctgaaagaatcagcggcttccttgatcaagcggttcaagaaagtatctgctggcatgatcgtagatatttatggaatctttcgaatgatctttgcagcttttaacgtgagttttggtggagttgctggatttgttcgtccgatcattctacctatggcattgggaaccatcgaatcaaaaggattaaaagtccatcctaagcatgaagaagaactaaaaggtatggcttcggctatggaaaatgtctgctggttctttggccaagtactattcatcggaggcgcaggggcgttgctagtccaatcaacactgaaagatctaggatatgacgtaacattgggacagcttgctttagtggaagttccagtggctatcacggctttagttgtggcaagtgtctacttctatcttaaagaaaagaaattagcgaagaaatattatccaggaaaggggcaataagatggacttttttacaaatcctgatattttattaggcgataaattactggagattctttatatcgtgatgggactcgtattgatttacactggagtaagaaatttaacagataaaaccaatcctcatcgttatgggtcagcctttttctggacggtcttaggggtagttattgcaggaggaagatggcttccggcaatcgtgaacggtggcttgatctttgcgatgaccataccagcaattgctaagaaagtcagcaaaggagaaagccggcttccatcaaaagaatatatggaaaaaatgtcagacaaactaggaatgaaaatctttattccagctttgagtatcggtgtctttgcgatcttgtttgctctatttaccaatttaggtgctttagtcggcgtgggcgtcggtgtttttgcagccatgctaatcttgatgttcttttctcgagataatcgaccaagtacatttttagatgatgcagcagatatgctgggcacagtagggccgttaagcatgttgccaatgcttttagcttctctaggtgcggtatttacaagcgctggagttgggacagtgatttccaatgcagtaggtacgatcgttccagaaggaaatgtgaacatcggcatcatcatttacgctcttggcatggtgatatttacggtaatcatggggaatgcatttgcggccatcaccgtgatgacggttgggatcggtgcaccattcgtatttagtcatggagcgaatccagcgttaataggaatggttgcattgacttgcggtttttgtgggaccctgctgacaccgatggctgctaacttcaatatcgtgcctgtagcgatgctggagatgaaagacaaatacggagtgatcaaaaaccagttgtttattgcgttatttatgctagttttccaaattgcttatatgattctatttaaataatagaagagaggggttgtgacagaataattgtcgcaacctcttctaacattgtagtggaacactatttttttataagaatatattaagtttgatctgttatgttatttaaactattgtttcctttatttacgctgtgcaaggaaaatggtatgataaaagataaccatatgttaaatcaatcggacggaggaacaacagatgaaagtactagtaacaggttttgatccatttggtggggacaaagtgaatccagcctatgaagcagtaaaaaaaatgccagatgaaatcagcggtgctgaaatcatcaaagtggaagtaccgaccgtatttgaaaaaagcagtcaagtagtcaaagaagccatccaacagcaccaaccagatgtcgtgatctgtgtcggacaagcaggtggacggtcagcagtctcgttcgaacgtgtcgcaatcaatctagcagaagcaagaatccctgataatgaaggaaatcagccattcgatacggctttagaagaaaacggtccagccgcttactttacctcattgccaatcaaagcaatgacaaaaaatgtacaagatcatggtctaccagcgtacatctcttatacagcaggaacatttgtctgcaacgatatcatgtatcgtttgcttcatttgatcgaaacacaattcccggcaattcgaggtgggttcatccacgtgccattctcacccgatcaagtgatcgatcgtccagtgggtacgccttctatgtctttagaagacattgcttcttctttgacttatgcagttgaagcagcagtagaaaataaagaagatatttccggaaatgccggaacaactcactaatttagcaagaaacactggctggttgctaacgttatgttagtagccagctttttgtaattagaaaggaaagaaacagccgtggaagaatggcaatccgtctttgaagaatggtttccaaaagaaatcagcaaaagctatcccatcaaaatttctaaacaatacacaagcagtcaacgttgggagatttatgcaaaattaacgaaaaaacagcgggaactagtcgataagcaccgccgatatctaatcagctctcgttttatggaagaacattatttagctgcaacagattgggtgttttctgacttcaagatcaatccgttttttcgaacaaaacgaagccagcaaaaattgtattgtgagtgtggtagagaattaaaagtgcaatacatcgttgaatcgccaaaaaccggaaagatcctaaaactaggcatcaaccactttgccgatcacctgcatgtctctccgacagtggcagcttcgatccatcagggaatgacaaaagttgatctggccttagacgaattattatgccttaagcagaagaatatcgattttcctgaaggactatggcaaaaatactgttttgtcttgtaccaaaatcgtcggatgaaacagccatatttaccggatataaaattagctcagcggctcgcagaatttcgccaagtagaaatgccgatttacatagcggattatcaagcattggaaaatgaaatcaagaaaataagtgaacacatcaatgggcagccaaaaaagcgacagataaaaaaagaactatttgacgactttgcagaagaattagtaaaggatgtagaagaattcttgatcaactatcgcgcatttttacgtaaagattggcaatccatcgtatatgaagaagtgccagtacatcctaatgcttattttgaaacatttatttccgtgttgagaaagacaaaacgtcaacgaacaccagaagtcactgctcagatggaatattttgcgaaaaaccaacgattcatccaaccaaaaatctatctatttatttggaagcaatattgtcgctatggttttacagaagggttcttcgacagcattcctcggatagtcagaaatggttttttaaaagtattgcgtaaagaacgagaagctatacaatctgctgataagaaagaccgtacagtctcaaaagaaaaatggcaactagtagtgaaagatatccaatctggaaatgtgcaagagacaatcgacaaatggaaaggaaaacattatcgttttactgaagctcagaaacaagcgttggaatattatcagaagttagaagaatcactgcgtttcaatgatgaggcaagaaagtatctaaaggaattactataaaaaatagaggctgggacagaagcgtttaactccaagaaataagaaggaattcacgaaaattgcttttcgaatttttgtgaatttcagcttatttccgaaggagttgcttctgcttcagccgtttatacgtgtttagagcgtgagacaaaagtgttctttacttttgtcccacgctcagtttttttatgcgtgttgttgtgcgttgtagtattcttcttccattttttgcatacgttcacgttctttttggttataccaaggtgaaacggtaaatgcaaggacatcattcagcaagtaaacagagctgttcacgaacatcgccaaacttgcagatccatgcgtaaatgaaatataccaaaggaccatttgagcaagccctgaagctaaccaccagtaatattggttgttgtaacgcaagaaactgatgataccagcagtcaagctaatagaaaaagcaatggcatctacccacggccgaggatcatctgtataacgaccaatcaggaatcctgaaacaagatagacaaggaaagtactgatgattgcgataaaccagctttttccagtgaattttcggatttttgaagccatattatgattccattctttacttaacaatacggggatatccaatgtgatcatataagcaatctgttcaccgatacttaaatagttctttgctgagaatccaacgataataaaacaaatcgcagacaaaatacctaaaataccgttgactgattttgccgcattgatggataaaatacacaatacaccaagggtggtaccgataaatgtaataacggacagccaagtgatgggactattgacaagagtcatgacctggcagccaagactgaaaaagaaaagataataattttgttgcggccagccttttagctgatgagctaaaaactgaaaatatgacttcatgtatgaggactccttaagacactaaatgtagtgtgttctgtatttactaacacaatctattgtatgcttttcttgaaaaaaaactagtctttcaattataaataatttgtgttatgataattttctgtttgttttcttgaaaatataatttcttactttcatttattatattgggaacaggaagagtgtcttggaggacctactttctgtttttttttttgccttttttcttataaaaaggaaaaacagctatttttttcaatctgatacatttacaatggaactggagattaatatagatccgagcttaaacgaagaataggagtgctcatatgaaccttacaacgatccatcatatagccatcattgtttcagattatcagaaatcacgtgatttttatgttaataaattaggatttgaagtaatcagagaaaattaccgcaaagaacgagatgactataaattagatctgaaactaggaagtgctgaattggagatttttggaattgctaatgcgccacaacgaccaaactatccagaagcttgtggcttgcgtcatcttgctttcaaagtagacgatattgaagaaacaattgcagaattgcagtccttagggatcgaatcagaaccgattagagaagatacctttacaggaaaaaaaatgacgtttttctttgatccagacggattgccattagaactgcacgaataaagataacaaaattgtcacttttttttcgtttcattcgatttttcattcgttcatttcttgatattctttaaaaaaaagaaacaggagaatgaagaatgaaaaaaatgatgtttggtgttgctgccctcatcgtaatagggattaccggtatgacgggactgctcaatgccgcttttcacatggatgatattagtgaccaggaatatcggatctcattgaaaaaagcagcagcaattgtaaaaaacgaaacaaaagaacataacatatctgctattcattttgcagttgaaaaagacttggataatcctacgaatgcaacatatgaataccagtttttttgtgaaggacaagtcatagcagtcaatccatccactgggaaaacaaccgtacgaaatgacacgaaaaaggccgcagaacatctttttgatatagaaaaagcggaagagttcaaacaaccgcaagcagcgatgaaggaagcagtcagctactacgggaaaaaagcaaaagtgaaagagtggacacttctagtcaaagatgaacgtccttattataaagtccgattaatagatggagaacaggaccgtcaggtatggatatctgcatagaagaaggatattgcttctcttttttacaatataagagtaagctaagagagtaaagatgaaaggaagttgagataacatggaaaaaatgaaatgccctaattgcggaaaaaaatttgcatacgaagaagtcaataatgtagtcgaacataatgataaagaaatgccagtcgtctgcccttattgccgaactgaagcggcaagaatcgttactcatggttatttcattactgaaaagattgaagattttttaaaataacgattttgcgatttctttttttgcatgttagaatggagaaaaggagaggaaactatgattcgttttgcgagaaaagaagatgctccagaaatcgccccattgatcttagtgattctaaaagacatggaattgccatttttgaagcagacaggggaacaaaaggctttagagattttagaagaagcaatcactgatccaaattatcgttacagttattcacgaggtatcgtagaagaaatagacggtaaagttgcaggagttgcttacggttatacagatgaagaagaatcaatcatcgatcagccactggtacctatcttagagaaatatcagctagatgcgtctacacgtttgtttattgataaagaaacgtttcccgatgaatggtatttggactctatcagcgtatcagaagattttagaggacaaggcatcggttcacggttattagaagcattacctaaattggcgaagaaagctaatcgctccgtcatcggtctaagtgtggatgaaaaaaatccaaaggctaaaaaattatacgaacgccatgacttcaaagttgtcggtcagcggatgatcagtggtcatctttatgatcatatgcaaaagaaattaaattgatttaaattgtcaaatagtgaaaaataataatggtgtaaagaagaatgaacgttactaaaaattgaataggttttaataaggttgtgacagaagtggtcagcttcaagaaataagaaggaatttacgaaaattgcttatttttgagctatgtacaagaagcattttattctagcttaatttgacaaatcatataataatgaaaaaaggttgtgacaaaaaacgtgtcacaacctttttttacgaataatcgatgctcaatcagctggttctcggcattccagaagtagattctccaggaattttatcttattttttgaagctgctcccttttgtcataacctttttgtataccatttttcttattatatgcgttagttctaaataggtttttttatcgaattttaccggatttgcttgtcgcccatatatttcagcttcatattgagcagttaatcgaatgaaacgttgatctagattgaatgtttgttctattcgttggctgtatgcctgcaaagattctgcgagggtgcgcggtaccagtgtttccaaatggtggagaagtttttgatacgcaaccgcattagtagaagcaaaaaaatgaagatagataagataacttgtccagcgcagagattttctaaataacaatagaaagaacaacaagacggataaacacaccccaaggctgaataagacgattttataagacggtgtgagcgtcgtgttatctgacgaaatagtcgcaggtctctcactggtaatagtttctgctatattttcgctttcttttggttgttcttcagcagattggacggtttctgttgtttcagcggctggttgtgaaacagttggattggcaaatgaaggggttggttcaaatggaagccagccaaacccaggaaagtacacctctggccaagaatgagcatgactattgagaatgctgtattcctcatttccttgctcatctgtacctgttctaatcccatccgtaaaaccttttgtccaacgagcagggatgcctagtgtgcgaagaaggacgaccatagaagttgaaaagttgtcacaatagccgacttttgaatcgaagaggaaataatctacataatcgcgttctttaggcgtatgtccggtatccgttttggaatagcgaaaactcccgcttgttttcaaatactgttcgacagcttcgactttacgaattaaagttgcttcatttttggtcaattcgatcgccaagtcctcaatccgttgaggcaaccctttcggcaactgaagatttgtctgttgattttctaaatcatcggccgctaactgactgctttttaattcttctctcgtaaaagctaatctttctgtttgtaaggacgccaatcgcgtcgattcattcgggacagggatgaatcgttggctttcaggcaaatagtaaagcgtttgtccactggctaatgaaaaatcagtcaaggtagtatttccataaggataaggtaagaaagcttggttttttagcgtcaatgtaatgttttctttttcttccataactgtttggtagcttgtgatatcaacaggaaattcttggattggttggatgggtgcatccggatcttctacccatccagaaccggtgtaatgattcttattttctatcttccaatagccgtttactttctggttcgctgtaaaaacaacttcaccattatcatacaatggaccaccaagttgttcatcattttcactgaaacccgttctggcacttccggttaattggtactcatggagtgtatcataaagcccttcatcattaagatattctcggatcggttcactcgtttcctcaagagattggtgtacttttgggagatataaaggcaagatggcgctgaaagtgaacaaacaaataagcaggatcgtagtaaacgactggaatcgagcgtttcccgacaacaatcggatggcgaaaaattgccttgctgccaaatatacgcataaaacagctactaccgcaatcatttcgtacaatagttctttttcccgaaaaacggtaagcatcatgaagtaagccatcaacgcaagaaagggtgcataccaatagtcgtaatccacggtcaaagtaataaataaatagatcaacaacaatatgagaaaaaaagctgtcttttctggtaaataatgaagtttaccttgggatagatggaagaattcctctgtaactgacgaaaaaaactgtacgacccataataaagaaaatgtctttgaaggaaaataggcaaacaaacagccaatcattactggcaaagaaagtagcaatcgtacccattttttagaaatacagcagacaataagacataggataccaatagttaggataagaggggagctgttttgcaattgattagctgctacaaatatcggagcacctacacttagtatcataaaggagtaaacgccgcgcaggtatttttcccatttaatcgtcaatccattcacctcctggcaatgaacataccttgtctttttcttggatcatgatttgtttttctgcgaaataaacaagatagaccgtccgatctttcgacaatgtttcgacagcttctgagacttcaggagaatgcgcaggaataaagaggacgatttgtttttttgcctgttttttcaagtgtgccaaaaaagttttctcatctccagcgttcaaagaagcaaaataggtatatccaggatctttgccatgaaagatacggtcgcctaatatcagaagttccggctgcttttcttttctcagatgccataaagaaaaatacaaatctagcagatggtcaaatttcaagctaggtgaaccccaaaagcaaagaagcggagaatattcttcttcttgatactcgtattcgcggtataaccactcttgactatgagcagacaatttccaatcgattcggttaaaagaatcgccggggcgataagagcgatgttctcgaaaatcaagacctttttgatacgcgttcagctgttgttttttttccagaactctctgcaatgtttctgcttgagtcttatgaaaagctggaagaacagtcacaggaaaagaaagctctcttcttgtcctttttctaaaaagtcctagactatcataggctgtaaaaatgacggttaatgcttcatggaaccctctctcttttggttgccaaagtacttggacttcttgcggtttatttgtaaggatcaatatttcttgtttttttctgtaaagatctctggaaagacgatctgtaaacgagggagagggaaagaaaaagctctctttttggctatagaaaaaataacctgtatattttttttacgataaacgactggctggactgtgcaagtaacagaaagtttctttagaaaggtgcttaatgaaaacacactccatgatacataaagagtaaaaaaggccaataagaaccaccctaaagaattgttgaatacaagagcaaaaaagacaatgacgaaatatatcagaaataacacaaaattaatgaaataatctttggctttttccattatctacctcacgggaattgggatttgtgcaacaagggtatggatcatttgtgtcttttcgtcttccttcaatgaacgatcgtaaaaaatcaagcggtgagaaaaaacgaaaggaactaactcctgcaaatctttgggcgtgacataatttctcccatggatcaacgcataggcttttgctgcctgaataaaggcaaggcttcctcgtggactgatgccaagctggatagcagagtgggttcttgttgcggatactaactgcaaggcataagatgccacttctggactgacaaagacattcgccacacttgtttttatttcttctatttcttgactgttcaagacgaccttcaaattattcaacactttttcaaatttatccaaaagtagcagaagttcgtcgtcaaaagaaggataaccaatttgtagtcggaataaaaaacgatcgagctgtgcttccggcaaaggatatgttccttcatactcgattggattttgtgtagctaagacaaaaaaatgattgtctagggggtatgtattgttgtcgatcgttgcatgattctctgccattgcttctaaaagtgctgactgagtgcgaggagtcgtacgattgatttcatctgctaacaagatcgttgtaaagattggccccggacgaaattcaaactcttttgattgtgagttatagacagaaaagcctaaaatatcactaggaagaagatcgggtgtgcattggactctgctaaaggttccttgcacagcctttgctagtgctttgactagtaatgttttacctacaccgggaatatcttcgaacaagacatgaccacctgctagcagggcaacaatcatcaattggatagtggaacgtttaccgatgaccgctttttctaattcttgtatcaactgatcgattttttgtttggattcttcgattttagcttccattttcacatcaccttctcatgaaatcactatttattttaattgtaatggaaggggatacatcctacaagcaaagtgattttattatgtttttttaaagtacattcgttttaaaatgagaatacaattaaattaagtaaaataaaaaataatgagagaaatttgcgtaattaagtaaatagaaagggactttttatctttttagaaaagagccctttctgatcaaacaatatgtttagaaactaggtgagagatgatcaatgagatggcaaaaactattatcaaaaaatgcacagaatttattttcactaatcaacctaatgaaagatctgatctggcgaaaaacggatttagctgaagaactgaaaatcgatgtcaaaacagttgatcggcatctaaaacgtttggcagaaagcgactgtccaatccaactgattcttcataagaaaaccgttcagttagtttatgatcaaggatatagcgaaccttacctcctttttgtttttctgatccaatcaccacctttttgtctactgaaaaatctgctgttgaatgaaccttatgaacaggagtatgatcgttcgacacaagagcggttgagaaaatggtttggtgagtatcacctttcattttcttataaaaaagcgcggatctttggttcagaaagaaaaatacggtacctgctattttgtttcttgaaagatttcccccatttttttgcagacgatggagagcaatccttttcagagacattcatccaattattgaagcaacgaaaggatccggcagaaatcgagattttaggagacagtcgaacccttttctttgagttgtttccagaattgctttttagagaagagcagattttgccaataaaagaaaaaaattatctagcgattttgcgcttgagctgtaatcagattactgaaaaacggtgggaacggatagaagagacacaagactatcggaaattgacgatcgtaactgaaaagcttgactcgctgttttggctgaatagtgagtttgaaagtggaaataagtcaaaactgacaaaagtactttaccaagaatggcttcgttatgtgattggtatccatgaccgactggtggaagaagaagttcgttattatcaggaaacattagaaaagtttcctaattccaaagataaactctatcaatttcgtctagcaatccaacaagcacttgcacaccccgcagttgaatggggaatgcttttacttaagacactccaagaacgggggtatttagatgtccatcctcctgaagtgaaaatcgtcttttttttcgttatgaacatcaggaagcaagaagacttgccggggtactgaacaaaaccctaagacatcgaaaacggatctcgatccatgtttgcactcgaaataagccacctcgttatgcagatctagtgattacggatcatttttttccattagaccataatgaagatcaaaaaacgtatctgtaccatccttcatttggtattgaaagactacttacggatatcaattactggttagggaaaaactgataaaacctttggaaaacagatcaaaacaagtcagtctatgctataataaaaagcgattagtaaaggaggaaatccattggaattaaagaaattagaagttcccacatcttcgatcacagaagtgaaacgatcgccgatggatgtatttgctcaagcgcgagacgcgggaactggcgtatatatatttaatcgggaaaaagtagctggtgtgatgctgacccaagaacaatacgaaacgctcttgcaagaactagatgtccttcgtcaaacagtgaaagaggaactgaaagaaccaaaggaaaaagaaatacatgaagaatctgtcaataaaacagcttccgtcgtatccaatgctgaagggatggaagagttggctcaaacattacagcactcgcttattacgggtgtgacgattacagcaaaaaatctagatgaacgaatggtcgcacttggttttattacgaaaaaaaccggatttggcggggtcgtggatatgctcagcgaattgatgaaaaccgggaaaatcaattaccagctaagaagaaaaccgcaaaatcggaccatcatcgctgaaatcataggggagcaaaacagtcagtcccaattgatggataagatcattatcaaaaaaatttttctacatgaattataagaaaaccctatatgtacaaaaagaagaaaaacagcttctctttgtacatatagggtttgtttttttagggatgccgtgcttttttataagataaggctaccgcccataacgatccaaggatttgtggaattaagtaaatgccagctagaatcaaaatcagttgggtcggttttaaaggatgataaaagtaccgccattcagcaaaattgacgcaaaacaaataggaagtgacagtagatataatattggcgataaataaagataaaatacgcctgcttttttggaaataatacccagcaaaaagagataaaaatatcaacgtgatgaatccgcttacggaatgataatggaaatcaagcagtaaagcgaaatgcacataaggaacaaaagataaaagcaatggaagattcttccaacacgtttttatcatattttgtcaccacctaacaagtgttattattttgttagttttattgtaaattgaatcatataataatcaattactttttcattatttctagattaaatgaataaactctcatgccattatctctaaaaaaaaagtttttccccctaatttttttagatagaaaattgtatagtatgatgaaagaaaaattggtttgggggaacattgatgagaagaaaagcagtaatcgatcggctttatttatttttttggttttttcctatcgttttgctaccttttacatgggtaaatgctgttgtgcaaggggccgagatattagggctgatccaaggaagtggatttgtggtttctagaaattttccagctttgactgttttttacttagtgataagtgtaggtctattactgccaaaatctctgatcaatcattataattggcagctgctttatttttcttgtttactcatattcacatctatgttttccttgttgcctcgcatgatcatcggtcctaatggtttgagcgagagcggactgaaggattcagcatatccctccatgtatttcttgaccattaaaccgtgtttctatttagtcattgtctcatttattcttgcgacattcttttacttctggacagagatccggataaaaagtgaacgatctgtatttataaaaaataaccgttgatggtggatcatcggtaacaagcatatgagcggcggaaaacgcctgtttctcatatgcttttttattatcgtgtaaagattctaaaaaacgtttacatgatttttacataacttaactatatttttacagcaaccatacgagggatttacagtcgactgataaactttagttgtaaataagaaaggagcaataaaatgaaaaaagtattgtttactctaggtatgatgggaattcttttagccggatgcggctcaggatcaggaaatacagatggctctgccacacaaaataattcaagtgactcaaatgaacaagtaaaaatcgttgcggtaggttcgacagcattgcagcctttggtcgatgcagcgcaagaaagctttgtacaagaaaatccgaattatcaaatctctgtacaaggaggaggaagcggaactggtttgagccaagtcgaagctggagcagttactatcggaaactctgatgtatttgcagaagaaagagacgggatcgatgcctctaaactagtggatcataaagtagcagtagttgggatggcacccatcgtcaacaaagatacaggtgtcaaagatatcacaaaacaggaattgattgatatctttacaggaaaaatcactaattggaatgaagttggcgggaaagatcaaaagatcaacgttgtgaatcgtgcaaacggcagcggtacccgtgcgacatttgaaaaatggggattagatggtgccacacctatacagtcccaagaacaagactcatcaggaactgttcggcagcttgtaagtcaaacaccaggagcaatcagctatttagccttctcatatctcgatgattccacacaagcactaagtatcgacggtgtagaaccaaaagaagagaatgtagcagataacagctggaaaatctggtcctatgaacatatgtacacgaacggaaaaccttcacctgaagtccaaaaattcttagactacatgatgacagaagaaatccaagaaggacctgtcaaagaattgggctatttaccaatcacaatgatgaaagtagaacgtgaccacgaaggaaatatcaaataactagcagataaatatgctacagttatcgtgactatcaaggaaaaatcaactatgtttccccgcatatagatttttcctataattgagaaaaagagcgacgacatagaactgtcgtctctctttttttgctatatgacaggaatgaaaggtgtatgcaagcttaataagaggaacacttttcatatctgttctatactggataggagaagtttgtaaatatccagaaaacgaaattgatcgaggtagccacatgaagaataaatggacaaatcgaagtaaaaaaaagaaaagaacacaaaaatcatctgacaaagttatccgtctttttccctcgtacaaagaaggattgacagcagaacaagtcaaggaacgaatagaaaaaggtgcagcaaacgattcagtcgatcccacattcaaaacaaaccaacaaattatattggaaaatatttttacgtatttcaatttgatctttcttatcttagccattttgctttgcctagtagaatcttataaaaacttgacctttttaccagttatcatagccaatacaggaatcgctgtctttcaggaaattcgatccaaaaaaatcttggatgaattgaatgtattgaatacagcaaaagtcaatgtcataagagaggggatagagcaaacagtagctatagaaaaccttgtattagatgacattgttattctagagactggacatcagattccagcagatgcagaggtcgtggaaggaaaactgcaagtcaacgaggctttattaacaggtgaagcagatgagataaccaaagaaataggtgatccattgatgtccggcagtttcgttgtttccggaaaagcttacgcccgattagacaaagtcggagcggattcgtatatttcccaattgacagtcaaagccaagacaatgggagaaggagaacagtcggagatgattgcttctcttaatcaattgatcaaatggattgggatcatcattattcctatcggtattctgcttttttctcaaagttacttttttaatggaaacacgatgaaagaaagtgtcgtcgcaatggaagcagcattgatcggtatgatacctgaaggactgtacttgctaacgacgatcgcattagcattaagtgcgactaaactagcaaagcaaagagttcttttacacaatatgaaaagcattgagacattggcaagagtaaatgtcctttgtgtagataaaacaggaacgatcacagaaaacaaaatgtctgtccaaaaagtgattgtctctaaaaaacaagaaataatcagccaatcagatcaactggaagagcgcattgctgactatgcaaaagcgatggcaggagacaatgcaacaatggaagccgtcaaagaatactttacaaaaaccactgatcaatcctatcaccaggtcattcctttttcttctgtccaaaaattcagcagtgtagcgttggaagacaaggtgtatgttttaggagcacccgaaatggttttgcgagatcagttgccggaatatgcggaagagtttgtttcttttgctgaaaaaggctatcgcgtgttggtctttggtgtgtacgatgggattcttgaagaaccagtattgacggaggcagtcacaccattaggctatatcctgatcgctaatcctatcagaaaagaagcaagagccacattcgattacttcaaaaaacagcaagtagccatcaaagtgatttctggagataatccgctcaccgtatctaatgtagctgtccaagcagggatttcacatgctgatcagtacattgatgcgtctaaattatcagaagaagaatatgaagcagctgtcgaaaaatatacagtttttggacgcgtcaagccagaacaaaagaaaatcttcgttcaattgctaaagcgtaacaatacagtagctatgacaggtgatggcgtgaatgacattctagccatgaaagaagcagactgcagtatagcgatggcttctggcaatgaagccgccatgcaggcctcacaagtggtcttgcttgattctgacttttcacgcatgccggaagttgttgcagaaggacggcgcgtcgtgaacaatattgagcgatcagccagcttgtttttagtgaagaatattttttcctttttgctttcgctgttttcagtcatctttgctttgacctatcctttagaaccatcacagatcacattgattagtttgtttacgatcggactcccatctttcttgcttgctctagaagaaaacaaaaagcgaatcaaagggaaattcatcatgaatgtgatggaaaaggctgtgccaggtggactgacagatatgatcgtagtcggtgcgttggtgatctgcggggtgactttgaatctaaataaaacagatgtttctacagcatctactatgcttttgattgcagtaggatttctcgttctctataaaatctgttcaccgctgaataaattcagaagtcagatcattcttttctgtgctagcggtatctttttttcggtggtttttttgcataaacttttttcaatcaccggtatctcagctgtatcgcttttgttgttgagcattctatttttctcggcagattcgatttttaggcatttgactacattggtagaatatttgtttgaacgtaaaaatgaaaaagagccggagataataaataaattgcctcggttccttcgattattcaaaagaaataaatgactaataagataaaagaagcttaaaaaatacattaaccaaaaaattgtattttctaagcttctttctgtataaaaaacaaagcaaatttttatctagaacttatagaaaaccaattaaatctttacttcaggtgtcctataatcattttgaaagcgtttttataaaattgggagggatgcttcaaatgaaaaatagaagattgcttcaatttagtttatttttaggtgtactgtatgggattttcttatccgtttccattgatgcttgtacgacgattttagtaggaaaaaatgcttcagtagatggatcaacgatgattgctagaaatgaagatctgaacacggcttggtccaaacactttgttgtcagaaaagaaaatacgaatccttcacattttgtatcaaaagggaatggatttacccttgatcttccgaaagaacagctgaagtacacagcgaccccagaatgggatacgtcagaaggattatttgaagaagatggtatcaatagcaagaacgttgcaatgagcgctactgaatcagctacgacaaaggaagagatattgaaaaaagatccatatactgcgcatggtatcgcagaagactctatgttgacagtgacccttccttatattgattcagcaagagcaggagtagaacgattaggaaaaatcgttgctaagcaaggagctgcggagacaaatggtgtgattttctctgataaaaatgaaatctggtatatggagatacttagtggtcatcagtgggcagctgtcaaagttccagatgactgttatgcagttattcctaatatgttgtcaattgattcatttgatttgaaggacaaagattcttatctttgttcagcagatttagaatcttttttagaaaagaatcaactgataaatacgaaacgggatatttctttaagagacatatttgcagataagtcaaaggatgaaaaatacaatcttcctaggatatgggatgcacagagaaaactgacaccttcaaagaaacaaaaaataacagaccgttcatttgagatgttcatcaaaccagataaacctatttcaattgcagaaacagcttatatcatgacattacactttaatggtactgaatatgataccatcgaagggacaaagccagataagtatcgtccaatctctgtgccgaatacgatggaatctcatattctacagataagaaacaatgtaccagaagaaatcagtggtatccattggttagcgttggggattcctgatacaagcaattatataccattttatagcaatataagcgagacacccgaagcttatcaaaaaggaacagatatgccagatgatatttctgcttactggacatatcggttgacgaacatcttgacgaagccatactatagtgatttcaagaaaaatattactttaccaactcgccaaaaagttcgagaccatctatcgaaagagttagcaagtacagaccaacaagcaagagaattaatagtaaatcatcccgaaaaattaacggattatttgaatcaaaaaacacaaagttttgctgattatgctatagatgcttatcagaaaatgaaccaggagctgattgtaaagatgtcagaaaagacagctacacatcatgacaaagatttataacatgtggctcagcgtttttagctaataaaaagcctgcttttcagcgtagtagatgatcgttagacatctaaacattgctgcaagcaggccttatttaattgcttttcggaatggtaacggtgaaagtcgagcctgttccaagatgactgtctacagtaatcgtcccatgaaggagttgcacgtagtcttttacaatcgctaaccctagtccggtcccacctgaatgccggcttcgcgccttgtctacacggtaaaaacgctcaaagatccgttcctgatcctcaatgtcgatacctataccaaagtcttggacagaaaacgataattcatctgttgcctgataacggataatgatctcgctgtcgttttttgaatattggacagcattttcaatcaggtttttgaggattggataaaggatatctgttttagtagtaaatggttcgttctttccaatcaatcgaatcgtcaaccgtttcttttcgatgattggctgataattttgaacgatttggtggaaataaggttctgtataaatcgtctggatttcgtaagaattctcaccgtcttttgacagctggatgatttcccgaatcaatttatctaaccgaatcgcatctttttgcatgatctcaagaaaagaagtcagagtttgcgggtcatattttgcaccatccaataaagtctcggtaaaaccaatcaatgaagtcacaggagtttttaattcgtgagagacgttgccaacgaaatccttttgtagcttttctaaacgtcgcactttcgttaagtcatacgccacccctagaatctgtccggtaccttctgaattagtaaagtagcgcaaactcaagtctaatgtctgtcgtccttcagtgatggtgatctcctgatggatcagcggatgctcaggagtcacttggtgaatcagctgaatgagttttggctcttggatgacttctgtgtaccgttgttcaggttcatagctggtcacatttaaatgcaactgcatctttggattaagcagtagtaaacgagaatcagcatcatcaatcaggaatacgcctatcatcagttcgtttaataatgtgtacaattgttcttctgttgtagtatacgctcgatacatcttactcatttgttcgctcagcgcattgatcgtctgatacaattcctcccattggtcaggtgtctgcatgattacttctgcttggtttggattttgtaccatttttctaagaacaggcaggacagttttcaaaggctgatttttttggtagatcaggtaatagatcattcctgcaagaacaaggaagaaagacagaaagaagaaaaagacccaacggcgaaaactttccgttctcggtaaaaatccgcttgtcggttctgcgatacgtaaaatggcttctaactggcctccttttttgactggtaatgcgacgtataaaagatcctcattcaaagtagtacttttgcgcaaagcgctacctaggttcccaccattcaatacagcttttatttctggacgagaacttcgctgttcattcaatgtttcattgtttgtgtcaaataagatttttccagtagcatccattaaagtgatccgttcgttcgactgatggacgaattcttccaaagcagttttgttttgcgccgcttggaggttttcgacatctaattgccggatcagtagttgtgctttttttgtcaggtagctttcttgctgttcgacgatctgttgttggaaataatgggagatcaattgccaaccaccaaaaaataaactaatcaaaagaataagaaagaagagacgttcataaacttttttccatttcatcgttttggttcctgaaacttatagccaaatcctctaacagtcaccaagtactttggatgttttggatctcgctcgattttttctcgcaaatgactaacgtgcacatctacgattcggctttgtcctgcgaagtcaaaattccaaatgcggtctagcaatgtgtcgcgatcgatcacacggtcttttcgtttcatgaaataaacgagtaattcaaattctttcggtgtgagttcaatcagatgatcgtctacggtgacttgataattggtcaaatcagcagtgatttgtccaatcgatagatattcaggttcagcttcatcttttgattgcttacgaggttcgatccgtctgaatatggctttcatacgggctaatacttcacgtggactaaatggtttggtcaaatagtcgtcagcacctatctccagaccaatgatccgatccacttgatcatctttagccgtcagcatcaaaatcggtgtttcatttttttcttgacgcagccgctgagtgatctccatgccatccattgttggaagcatcacatctaaaatgatgaaatcaaatgattgttctaatgctaattctaatccttcgcctccatctgcggcactggttaccttatagccttctttttccaaattgaacgtcaagagcgtcacaatagaaggttcatcatcaacaactagtatttttttcattcaaatctcctttaaataggtttcattctgtttatattttagcatagaatcagtacaaggggctattttacaaaagaaataaatggtataataggaaggcactttgctgaatagaaaggaagagcagtcaatgattggaatcagtgcatgtttaggcggtctagcctgtcgctatgatggacagaaaaaagaagtaccagaattgatggaactagttgaaactggcgaagctgtcatggtctgtccagaagtaatcggtggattgccaatccctagagatcctgctgaaatcattggtggaaatgggttcgatgtgtggaaagatcaagcaaaagtatggacgacaagcggcgaagatgtaacggaagcgtataaaaacggcgcgatcaaagcatatcaaaaattgcaggaaaaacacattgatctagtcattatgaaggaaaaaagcccttcatgcgggacccattcgatttatgatggaagcttttccggaataacaaaaaatggcgccggagtggccactgcttattttattcagcaaaaaatgactgtgctctctgatgaagaatggctgaaaactagaggtgagcagaatggaaatcgaaaagaccaatcgaatgaacgcgctctttgaattttattcgaccttattgacagaaaaacaaatgaactacatggagttatattatgcagatgatttttcattaggtgagatcgcggaagaatacgaagtaagtcgacaagcagtatatgacaatatcaagcggacaagcaagatcttggaggattatgaaaaaaaactccatctcttctctgattatattgtccgagaacagatattggaaaagatgaccgcatatattacagataagtatccggaagataaaaaactgcttgaatatgtacagcaaattcaagcaatcgaagaataaataaaaggaatgaagaaaatatggcatttgaaagcttaactgaacgtctccagcaggcgatgggaaaactaagaaaaaaagggaaagtatcagaagctgacgtaaaagaaatgatgcgggaaatccgccttgccttactagaagccgatgttaacttgcaagtagtcaaagactttactaaacgcgtacgcgaacgtgcggtaggggcagaagtgctggaaagtttatcacctgcacaacaaatcgtaaaaatcgttgatgaagaattaacgatcacacttggttctgaaacagcagagctaaataaatcaccaaaaataccaactgttatcatgatggctggtctacaaggggcaggtaaaacaacttttaccggtaaattagcgaattatttaaagaaaaatgaaaatgctcgtccgctcctaatcgcaggggacgtatatcgaccagcagcgatcgaccaattgaaagtattaggtcaacagctagatgttcctgtatttgacatgggaacagaagtcagcccagtagaaatcgttcgtcaagggatggagttagcaagagaaaagaaaaacgactatgtattgatcgatacggcaggacgtctgcacatcgatgaaacattgatggatgagttgaaacaaatcaaagaattgactcaaccaaatgagatcttgctagttgttgatgccatgactggtcaagatgccgtcaatgtagctgacagcttcaatcagcaattagggattactggagtcgtcataactaaacttgatggggatactcgaggcggggcagccttatcgatccgctcagtgacaggcgcaccaatcaaattcatcggttctggtgaaaaactgactgacttagaagtattccacccagatcgtatggctagccgtatccttggtatgggggatatgctgacactgatcgaaaaagcgcagcaagactatgatgagaaaaaagcggaagaacttgcacagaagatgcgggaaaactcatttgatttcaatgactttattgagcaactcgatcaagtgatggggatgggcccactggaagatctaatcaaaatgatccccggaatgaatcaagtccctggaatcgaaaacgtcaaggtagatccaaaagacgttgaacgcaaaaaagcgatggtttattctatgacgccagcagaaagggcgaatcctgatctgttgaatccaagccgtcgtcgccgaattgctgccggttctggaaacagtgtggttgaagtaaaccgaatgatcaagcaattcaaggaatcaagaaaaatgatgcaacaaatgtccaaaggggatatgaacatcccaggtatggaccaaatgtttggttcaggcgtcaaaggaaaactaggcaaaatggcgatgaatcgaatgatcaagaaaaataagaagaaaaagaaaaaacggaaataagatgaaaaaacagcttcggtacagactgaaaatgtctactgccggagcttttctatcagcaatttttattctttactgatacaattactctaaacgaagaggtggtacaaatgagatgtccgtggagtgaacaaacagaaagtatgcggcaatatcatgatactgtctggggtgttcctgaatatgatgaccaaaagctgttccgaaaattgatgctagacatcaatcaggcaggattgagctggcagacgattttaaataaaagtgacgcattcgatgaagcatatgatcaattcgatatccaaaaagtcgcaaattatggagaaacaaaaatgagcgaactaatggaaaacaaaggaattattcggaatcgcagaaaaatcgaatcagctgtccaaaacgctaaagcagtcttgaagattcaagaagaattcggcagtttttctgagtatctttggtcgttttctaatggaaaaatcgttgattcttcttatcattcacaagaagaagtcccgacaataagtcctctttcagatgaattagcaaaagatctaaagaaaagaggatttaaatttattggcagtacgacaatctatgcttttttagaagcagtcgggatcatcaatgatcaccttgacagttgtttccgcaaagaagaggtcgtacgtatcggcagaaaataaagaaagggcgaataaagcatgcgaaaaatcatattttatggcgctgtaagtttagatggttatttggcaacgaaaacggatgaccttcaatggctttttgacactccgacaggtgagcaaaccacttatgaagctttttatgaaacaatcgatacgaccatcatgggcaggaaaacttatcaggaagcaaaaaaatatttggaaaccgaagcaatttatccagagaaaaagaatttcgttttttcaaccaatgcacaattacaattgccagatgctgaggctgtacacgaagagcctgttgcttttctaaaaaatctacaaatgacagaaggaaaagatatctgggttgtgggtggcggtcgattgatcaaaccgttagtagaacatcaaatgattgatgaatggtatatccagattgcccctgtattattaggggacggaatccctttattccaaaaaggaacctacgaagcacgttttgaattgctagatacgacacgattcggtgaatttatcgaattacattatgtacgaaagtagaagcaaataaaacaaaaggcaactataagcagaagtaatctgcatatagttgccttttttattattgttctgattttattctgctaatttgttagaaaaatctagatacgcatctaaaatcgtttggaagaaacttaatgttccttcaacgatattgccgttttcatcaattagattcgcaacgtttccgatatatgcttccggttgttgcaaggttggcacattcaaaaagacaagtgattggcgtagatggtggtttgcgccaaagccgccgatcccacctggtgatgcagtaacgactaaacctggtttatgatcccaaacactgtgtccataaggtcttgagcctacatctaaagcatttttcaatactgctggcacagagcggttgtattcaggagtaacgaaaacgacaccgtctaatccactcacttcctcacgaaaacgagtccattcagcaggagctttttctggggtttcaagatcctcattgtaaaatggcagatcatcgaattttacaaatacactttcgtacccttcgggaagcaatttcgcaaaagcttctgctacttttttgttgtaagaatcttttcttaaactaccaataaaaaatccaattttttttgtcatacgatttttcctccttcaaactatctataataatcttacaaaaaataagtaattggagcaaataaaaacacttactggcaaaagtttcgttttagttgacaaatgatcgtgaagtatcgttagtctccattgccaaccctcttagaaagtctatataatgaagaaaaaggagggataagatggaagaattatcattatcgaaaaatgtagcaaatttacgaaagaaaaaaggcgtgactcaagaaactctagccgaattcataggtgtgacaaaagcttctgtttccaaatgggagacaggccaaagtatgcctgatgtactcatattgcctaaattagccagtttttttgatgtatctgttgatgaactgctcggctatcatcctcaattgacgaaagagcaaatcagacacttttatcagcagtggaccatcgctttttctaaagagccctttgaatatgtgatggaggactgtagaaaagcggtcaaacaatattactcatgttatccttttcttttacaagtagccgttttgtggttgaatcattttatgctaacaaaggatctggaggaacaacaagcaattctgtcggaagcagaagcgttatgtacgaaaatcgttgaagaatcagcagaattatctctatgcaataatgcttctttgttaaaagtagcggtcatgctccagttaggcaaaccagaagaagctttatctgaaatcgaagaaaaagcggatccttatcgttttgcccagcaaagcgacaccttgcttatccaagcgtaccgagccgctggtcaaacaaaaaaagcggtaagctatactcaattcagcatgttttctcatttaatcaatctcgtatcttcagccactcattatctattgatccaaatcattcaattaccggttatagaagaaactgtcaatagaatagatgctgtaatccaagcattcaacctgacggcgatccatcccaacagttgtgctcaattttcttacgctgcagcctgtgcttatgcgaaacatgaaaaagaagaacaagtaataaagtgcttaaaacagtttgtggatttgacacttatacttttaagcgaggaaggcaggatccttcatggtgataggtattttgatgagataactgagatatttgaaggagcagatcttggggtacagcaaataagagacacgaaaatcatcagggaaggggcattaagtgcattagaaaatccgatttttcaacaaattgaaagatcaaaaattgaaaaactaaaaaaacgattggcaggcgagtaatatgggcatcaaagaatttcttccgtttttaattcctttaatcattgtacagtttggattacttatttatgtacttcatcatatctttacacattctgcatataaacatggaaatcgaatgatatggatgattattgttattgttggtatgcagtttatcggtcctgtcctttatttgatttttggcaaggaggatgcgtagtggctatcttgatacttgaaaaagtctcaaagtcttttggtacaaacaaattgctggatgatttatctttttctgtagaagaacagacgatttttggtttcatcggtaaaaacggtgctggaaaaacgacaactatgaaactgatcttaggtcttatcaaaaaagacagcggaacgatccgagtgaacggaaaagaagtagagtacggacaaacaacgaccaatcaagaaatcggctatttagctgatgtaccggttttttatgattatatgaccgcttccgagtatttggtcttttgcggcgaactcacaggaatgcctaaacagcggataaaggaaaaaaccaatgaaatgttgtcacttgtcggtctgtcgaatgaaaagaagcggatcaaaaaattttccagagggatgcgacaacgtttagggattgctcaagccttgttgaacgagcccaaattactcatttgcgatgaaccaacttctgctcttgatcctgttggtcgaaaagaaatcttagatatcttatcctctgtgaaagagcaaacgacgattttattttcaactcatattttatctgacgtggtgcgtatctgtgacaaagttgcttttttggataatggaaaaatcgtgttgtctggatcagtagacgaattgaaaaagcaaacaaatgctagtgggtttgagatcgtatttttttccaaaaaagagcgcgaacaatttgaagagcttttacctggagggatgatccaaagtgaactgcgtatagcttatccacaaaaaagtaaagaagaaatgctttttgctatggatttgctagccaaatatcaattgccagtccaatcagtccagatggaagaacctacgctagaaaaactctttttggaggtcgttcaatcatgagacaactcattgccttcgccaaaaaggagctaaaggaaaactggcgtactggaaaaatcatcacgctaagtgcgctcacagtgattttcggtataatgaatccattgctagctaaattgactccttatttagtgcaagctatgtcaacaactctggcagagtcagggatttctgttcagaaaatcatagttgatgcaacgacttcatggacacaattttataaaaatattccgatgctgttgattttctttcttcttttattcagcgggatattgacaagcgaataccaaaacggaacaatcatcaacttgctgacaaaagggatgaagcgatggaagatatttctgtcgaaatggatcatgggtatactattttggagtgtcagctattggtgctgttatagtattacgctagcatacacgatttattattgggaccagtcgattatctcccatcctttatttatcagttttacttattatttttttggctgttggctttattcattgattttattttattcagcttttctttcttccaattatgcggttctgttggctagtgggggaacggtcattctgagttatggtgctgggttgttctctaaagtagcagaatatgtaccgacttatttgatttcttcctcaaattatcttacgaaagaaatccaccttacagattatactcagtcattagcagtgtcatgttgttctatcgtcatatccatcgtagctgggtggcttgtttttaacaaaaaagaagtctaaaatctgctatttcctaaaaaaatcgaatttaatcaagctgtaaagaaaaaaagctttacagggtaaaaaaaaactgttacactacatcttgtgaataaaacaatggaggtggaaataaataatggcagttaaaatccgtttaaaacgtatgggttctaaaaagagtcctttttaccgtatcgtcgtagctgattcacgttctcctcgtgatggacgtttcatcgaaactgtaggtacttacaatcctttgaaagaccctgcagaagtagttttaaaagaagacttagttcttgactggttatcaaaaggtgcacaaccttctgacactgtacgtaatatcctttcaaaagaaggcgttatgcaaaaacaccacgaagctaaattctcaaagaaataaggtgaccggatatgaaagatttaagcgacttagtcttaacaatcgttcgtccgctagtcacttatcctgatcaagtcaagttagatgtcgtagagtcgaaagatttttacgagtacaacctaacagtggcacctgaagatattggccgtatcatcggaaaacaagggcgtgttgccaaagcaatccgcacaatcgtttacggtgttcggatcaatgcaccaaaaaaagtgcgtttgaatatcatcgatgataaggaaaagtaaataaacgtgctgtactcgaatttccgagtacagcttttttgtttttttattaattgaagaaatgattatttggcaaaagaagcaagaaagcgtatccttataataggagggagtgagcagataatgagaaatactatgttatttattccgtttgtcttattgttaagcgcctgcagtttgattactgaaagatcagacaatacgcaaccatcaagcagtacatctgaaactgttgcaagtacagaaaaaagtagtactaaaatggcttcatctactgaacaaacaaggggtacctcaagtaatgaggaaaagactgctttaaaccaattgaaagaacaacaaccaaacgtgcccatgcctttagatgtaccgatttcttctggctatctcaatgtcgcagcggcacaaacaaagcaaggttattctattttatattacggatcagatcgtcccctcaggttgaatgctgacgaattgaatcaagaaacgcctattgcaacttatctctatcaatatggatttgcttctagtcaagaaacgatacaagtcttgcagccatttgagatcgatacaaatgggcagaaaatggatttaggtcatcaaatcacggggtatcagcaaggagcagcaggttcaagctaccttgaatggcaagaaggaaattggcgtattcggatccgtgggaataatattgatggtcaagaacccttgccgttagctaaagaaatcgtagcctatttggaagaaaacaggctgccagcacctgaacaatttggtaagataactattgatatgggagatacgacgaatcgagccgtagaagtaagttggcaagaaccgaaaaatgtctatacgatcactcgtcaagaccctatggctgcattgaagatggcagtttctatgaagaagccatgacagaagtgctgagcttcaagaaataagaagtcatcaaaaacagtacgccacatttttgcaataaatttggcttaataccctaaaagaaaactagaattgcctctccgcacatgctaaaataaaacagacaaaaaagaaatggggatataagttgactgaatacttgaatgtaggaaaaatcgtaaacacacaaggtatcaaaggtgaagtccgtgtgatctcaacaacggatttcccagaagaacgttacaaaaaagggacggtgctgacattattccaagatggaaaagcacctattgaattaacggtcaaaagtcatcgtaaacataaaaattttgacttattgagttttgaaggtcatccttccatcaacgatgtggaaaaatatcgggatggcatattgaaagtgtcaaaagacgactctgtagatctagctgaaaatgaattctattaccacgagatcatcggtctgcgtgtggtggaagaagatggaacggaactaggtaaagtaaaagaaatcttgtcaccaggcgctaatgatgtttgggtcgttcaacgtccgaaaaaggctgatatcttgcttccatatatcgcttctgtcgtcaaagaagttgatttagaagctggagtgatccgtgtagaaatcccagaaggactgattgacgatgaagattgatgtattgactttatttccacgaatgtttgaaggtcctatgggtgaatccatcatcggcaaggctgtagataaaggtttattagacatcaatatctctaacttccgcgactattcagataataaacatcagacagtagacgactatccatatggcggaggagcaggtatgttgcttaaagtccagccaatctatgataatatccaagcaattgaacaagctgcacctgatgtcaagaaacgagtcatccttcttgatccagctggtaaacgattcgatcagaaaatggcagaagaattttcacaagaagaacacctggtattcatttgtggtcactacgaggggtatgatgaacgtatccgcacattagtgacagatgaagtttccttaggggattatgtccttactgggggagaattaggtgcgatggtcatgatcgatgcaacagttcggctgttgccagatgtgttaggcaatcagacttctgcccaaaccgattcttattcaactggtctattagaacatccccaatatactcgtccagcagaatataaagggatgaaagtaccagaagtattgacaaatggaaatcataaattgattgaagaatggcaattaaaagagtcgctaagaagaacctatcaacgccgacctgatctcttggaaacacttgaatggacgcctcaaatgacgaaatttttagaagaaatcaagaaagaagagcaagaaaaaacagcagatgtagccaagtaactttttctaaaatcttctttacagtagattgatagtatgttagtattttatggtgagtgcacaagcacttaactattacgatattccgctgtgagagaagctcataagaatatttggaataaggagaagaaaaccatgaatccattaatcgaagaattaacaaaagaccaattacgttctgacatcccagcgttccgccctggtgacactgtgcgtgttcacgcaaaagttgtcgaaggtactcgtgaacgtatccagttatttgaaggtgttgttattaaacgccgcggtgctggaatcagcgaaacttatacagtacgtaaagtttctaacggagtgggcgttgagcgtacattcccattgcacacaccacgtgttgcaaaaatcgaagtagttcgctacggtaaagtacgtcgtgcgaaattgtactacctacgtgcattacacggaaaagctgctcgtatcaaagaaatccgtcgttaatcatcgttatcagactgagaaagaactcttggtattcaagggttctttttttgttcttatcatgtaatgcaatattcttgattcagtattttttaattactcgactgggcgaataacttattaggatgagtctatcgacaaatattagtaaaaaaaagagccatatgataatatctttcttgagagtaaccgctttaacaaaaaatacagaatattctaacataaatggagtattcttagaatcaaaaggagaaagaagatgatttacacttatacggagcaagagaaaatgaaagttttggagacatttacgaaggatggaaaagtaaaacaagtaccaagcgcaacaaaaaagaaatacatcctgctgaaagaagtcttgaaacgattcgaacatggagtaatctatacagaaacagaagtcaattcgatattgatggacgtattttctagtgctgattatgtcgaacaaaggcgttacctaatcacattcggttttttcaaaagaagttcggatggtcgagcgtatcagttgatgggaaatgaaaattagaagttttgatgtatactaattgaaaaaaattcaagtatgcggcgtagaaccaatgtcgcatacttgaatttttttgtcatctgtatctataatacaaaaccaagaacgttattcaaaatatggatagccatgatcgattgatggagcggtattctcccaaatctcaaattatccaagcttggggagacttagatgatccaaagcagcgtggacgtatgatcattgactgtttgatgaatctgccattactttactttgctactgaggctaccggagatgagagttataaaacagctgcctacaaccatgcgaaacaaactcaaaagtatattgtgagagacaatgctactacttaccatacgtattactttgatgatgttactggagtgcctaaatatggtcgtacgcaacaaggttattcagatgaatcctgttgggcgcgcgggcaagcgtgggggatctatggattcacattaagttacttgtatacgggagacggttcttttttagagaccgccacgcaacttgctgattattttctacaagagcttcctgaagatttgatttgttattgggatctaatattcaaagaaggtagtcaagaggaaaaagatagctctgcggcagcaatagctgcatgcggattgttagaactttccaaacaactgcctgtttcagatcatcgtcatttcgattacgaagagatggcagtcaaaatcttgggagaattacaaaaaaactatacaacgaaacaagtagatggatcaaacgggctgcctctccatgccgtttatgataaaaacagcttaaaaggtgtagatgaatgtgtgatctggggcgattacttttatgtagaagggatcactcgtctagctaaaaaatggtactgttactggtgatgtataagaaaagaggaggattcatataatgaagcgatggaaaaaaatgatgattggatcaatagttttaggaatgtcactcgtatttggtgcttgtggtaatcaagaaggcagtagtgaagaatcagcaaatgaaattaccgtttcgacatggaattatgaaacaacacctgaattcaaagcgctctttgaagcattcgaaaagaaaacgggaatcaaagtgaaagcagtagatattgcttcagatgattatgacacgaaacttactacgatgctttcttctggagatacgacagatgtattgacgatgaaaaatcttttgtcgtattcaaattatgctttacgagatcagttagtcgatcaaacagaacgaattagagaattagatactgatgctgctgaaggaacatatgaaatgtatgatatcgatggaaaaacatacgcattgccctatcgaacggacttttgggtactatattacaataagaaaatgtttgatgatgcaggaatccaatatccagaaaatctaacttgggacgaatacgaagatttagcaaaaaagcttagtaaaaatgacggacaagtttatggagcatatcaacatatctggcgttcgacgatccaagctattgcagctgctcaaaacgaagcgaatcttgtggaaccagattatcgatttatgactgattattatgatcgagcattgaggatgcaaaaagaaggcgcgcaaatggattttggcacggctaagtcaacgaaagtaacctatcaatctcaatttgaagaacaaaaagcagcaatgatgtacatgggaacttggtatatggctggcatacttgcgaacaaagaagcaaataagacagaagtagaatggggaattacagctattcctcagaagaaaaaaggagaatcggtcacgacgtttggctcgccaacagcatttgctgtcaataaaaactcaaagaaacaaaaagcagcgcaagaatttattgaatttgcagctagtgaagaaggagcaaaagtattggcaggagtaggagtagttccttcatatcgtacagatgagattgatcagctttattttaacctcgctggaatgccaacggatgagatttctaaaaaagctttttctcctgatgaaatcaaacttgaatttccgattgatacgcatgggcctgcaatcgataagattttacaagaagaacatgacttgattttggttggagatgaaacgccggaaaaaggaacggcaaatatggagaaacgtgtagctgctgaaaaagaataatcatgaaaggagagaagccaagagatcaaacgctcttggtttcgtcatcgaaatggagaatagtataaataagaaagctacaaatcatttgcgtagaaaacgaacgtggatcgcttattcgtttatcgccccgaatttcattggttttttcgtttttacattaataccgatcctgttttcgcttgtactagcatttatgaaatgggattctttttcaacgccagaatttgctggactagataactttcgtaaaatggccaacgatgagaccttttggatttctttgaaaaatacttttttatataccgctgctgtagtgcccggcacacttgtttgttcgttagggctagctttactactaaatcagaaaattagagggatgaagctttttcgtacgatatttttctttccgtatgttacttctttagtagcaattgctgttgtttggaatatgttgtttcatccaacgatgggaccaattaatatctttttaaagcgatttattgaacatcctccaggttggacttcaagttcaaattgggcgctttgggcaattgtaattgtcagtatttggcgcgggatgggttattacatgattctgtaccttgcaggactacaaagtatccaaaaagaattgtatgaagcgtcttcgctagatggagcaaatcgatggaaacaatttttgaatgtgacattaccttcgttgaggccaactaccttctttgtaacgatcatgcttgtcatcaattgtttcaaggtgtttgacctggtgcaagtgatgacggatggcggccctggtcgagcgacaaatgtgttggtttaccaaatctacaatgaagcattcaaaaaatttgattttggttatgcttcagctatttcacttgttttgttcgtaattgttttgggcgttacggttgttcagttttcttggaataagcgtcgtacttaggaggtatgaaatggaagagagtgttcaaaatgaaaggaaaaaagcaaaaattttttcaaacgatatgacctttattcaatggttgggtatgattctgctaatagggctagctttattgacgatcattccttttttatggatggtttctgcttcattcaaagcaaataatgaagtgttcacgattccgattcaatggattcctaaaacttggcatttagagaactatctggttatttggtctcgtattcctttagtgacgttttttaagaatacagcttttttaagcgttgtgatcacattgattcagttgtttacttctagttttgctgcttacgggttttctaaactgaattttaaagggcgcgatattttatttttagcatatatcggcacaattgctgtcccttggcagtcttatatgatccctcagttcatcatgatgagaaaagtgggcttaacagatacgttgtggtcattggtgctattacaagcgttcaatgcttttggtgtgttcttgttgaagcaatattacagtagtatcccagattctttatgtgagagcgcgcggatcgatggcttatcagaatggggaatctatcgaaagatcattttaccccttacaaaaccggcgattgccagtttgacgatcatcacattcgttaatacatggaacgattatatggggccattcatttatttgtcttctacggaaaataaaacaatccagttagggttgaaaatgtttattgggctatttgatgcagagtacgcattaatcatggctccctcagttgtttctgttcttcctgttgcttttatatttttagcgatgcaaaaaatattttgtagaagggatcgcttcatcaggaatgaaggaataggaggcgattatgaaagagcagcgttttgacaaaaatgtttatatggaattcttttattggttgtatcaatcattggcaagtagcctttgtttttggtgtgtcaatatcttgtatatagcagctgcgttccttttgtcaatagatggaaggaatgtcttttcccttattttttcattgctttttattggtccgggttgcatcgtgatgataggcatgacagaagaattaacaaaagaaaaaagtttttcatcagtacgtttgttcataaagacgtttcgccgattttggctaaagggatttttttattggctatttgcttggatagttagtgtgatagcgatttttgattgtttcttttttatacgtttttcttatggaaaatggttgattccgttgtttgttttacttgcttgtttatcagtttcctttagcatcaactgctggtattttcaggtgagaaatccagcgtcaaaaccaaatcaagttctacgaatagcgttctactatacgttaaaaaaatggtatgtgagtttactagattttttactattgacaagtttgtttctcttctttttcgtaaagccccaatggtgtattctactaggtccttctatcgtatttggtttgatttacttcaacaatcgtaaattgatgagaacgatggatctgtagactttataaattgaaactttcaaccaagaatgacagttttttatgtaaaatctgtcattctttttcattttttgaaacatatggctaaacaaatgaaataaaacgtgctatacttctgaatgaaacaggtttagaaactgtatcacttatttgtgattatttctaactaataattaaaaataaagcataaaaaggacgatgttcaatggccgaaaaaatgaaacaaggttcgaaatctgtagtagaaagtttgattaaccatcacgttgattatgtatttggtataccaggcgcaaaaatcgatggtgtatttaatgaattagaggatcaaggtcctgaattaatcgtaactcgtcacgaacaaaatgctgcatttatggcacaagcaatcggacgtatcacaggagaaccaggggttgttatcgcaacaagtggtccaggtgctagtaacttagctacaggtttggtaacagcgacagcagaaggagacccagttttagcaatcgccgggcaagtaaaacgaagcgatctattgaagttgacccatcaaagcatggataatgcagcgctgttccagccaatcacaaaatacagtgcagaaatccaagatccggaaacaatttcagaagtgattgccaatgcttatcgtatggctaagagctcaaaaaaaggagcgagttttatcagtattcctcaagacgtagtggatgcgccagttgaaggtaatatcatcaagccattgagtgatcctaaattaggttctgcttctgcagatgatatccgttacttagccgaacgcatcagggaagcaaaactaccggtattattagtaggtatgcggggatcaagtgaaaaagaaacgttagctatccgtcaattagttgaaaagacagcattgcctgttgtagagacattccaagcagcaggagtgatctcacgtgaattagaagcgcatttctttggtcgtgtgggattgtttagaaaccaaccaggcgatatgcttttgaaacgaagcgacctagtcatcgcaattggttatgatccaatcgaatacgaagcaagaaactggaacgcagaaaaagatgcgcggatcattgtgatcgatgaagcaccagctgaaatcgatccatttatgcagcctgaaagagagttgattggcgatatctcagctactcttgatttattgacaggttcattagagcctcaacaagtgtcagaagatgcgaaagaatatttagcttctcttcaagcaaaactaacggagcgggatattgtccaatcaaaaggagaagcaggtattttgcatcctttagaagtcatcaacacacttcagtcaaaagtaacagatgatatgaccgttactgtagatgtaggaagtcattatatttggatggcacgccactttagaagttatgaaccccgacatctgttattcagtaatggtatgcaaacgcttggtgtagcattaccatgggcaatttctgctgcactggtacgtccaaatacacaaatcgtatcagtttccggagatggcggatttttattctctgcccaagatttagaaacggccgtacgtaaaaaattgaatatcgttcatttgatttggaatgatggacgctacaatatggtagagttccaagaaaaaatgaaatatcaacgggcgtcaggtgtagattttggtccagttgattttgtgaaatatgcagaagcttttggtgctaaaggaatacgagctacaagtgtagaggaattagaaaaagctttagaagaaggatttgcgacagaaggacccgtaattattgatattccaatcgattaccgtgataatgagaaattgggagaaacaatcttaccagatcaattctattaaggaagtgtcgacatgactgaaaaaatcttataccagcacgggacattaggagctttgatggccggcttgatggatggaacagaaacgattgctcatatattggaaaaaggaactctgggattgggaacattgcatggacttgatggtgaagttatctttttagatggcgtagcttatcaaggaagatcagatggctcagttgtccaattagatggaagtgaacttaccccctatgcagcaattacagattttacgccagatactagtttttctgtttcagaatctgcagatggagaacaattgaaaaaagacatcttagtaaaagaagatggggaaaatctatttttagcagtgaagataactggattattcaaaaacatgcatatccgtatcatgccgaaacaagaaaaaccttatcgaagactagcaaaaatttcagagtctcaaccagaattccaacaaagcaacattcatggaacattagtcgggttctttacgcctgaattattccaaggagttgctgcagcgggatttcatctgcattttatcgatgatacacatacatttggcggacatgtaatggattttgaagtaactgaaggaaaagttgagattagccgcatctcgtcccttgtacagcactttccagttgatgatccgacttttgttcacgaaacgattgattatgctgatttagcagcagaaatccaacaagcagaataaaaaagacagcgagatgcgtttaaggtaaacaacctaacgtatctcgcttttttgagaagcaaacctagcgtttaccaaaaaactgagctataatcttttccatagattaaaaaggagcggtttttatcatgtggacagaaaaacagaaaaaagatgcatacgaaattctattattacagcaacaaggattattagaagcagaagataactggttagcaaatttagcaaattcatctgcattgttgaatgaaacattacctgagaccgtctttgcaggatactatttatttgatggcaatgaattgattttaggaccgttccaagggcgagtttcctgcacacgtatcaagatgggaaaaggagtttgtggagagtcagctgaaaaacaagcgacattgatcgttgacgatgtcaaaaaacatgaaaattatatttcctgtgattcagccgcacaatcagaaatcgttgtaccaatggtaaaagaaggtcatttaatcggtgttttagatatcgattgcggagtaacgaaagggtatgatgaaatcgatcaagcatttctagaaaaatatgtagatcttttattagcaaattttaatataaatgctttttcatttattaataactaaaattgactattgaaacaaaaaagaagagaaatcaaaaataaaaagagccggaaagacagtggacatatctgtttttcggtttttttatttttttataaaatcacaagtgttattggttttcataatcatattttaatggtattatcattttaaataatgaaaaacacattaaggatggatgaaatatgaataacgaaactatcattttaggaaaaaaatatatttgccaacctattggcttgaaacaaaaagtggttggagaagtaatcagtaaattagaaaattgtgttgtgatctgcgtagacgaatatcatgacgtcgatcgcaatgaaatattagaaaaatgcggaaaagtagtggcaaaatacactcacgtttatgagttggaaacgacagaatgtctatataattacagcaataaatatgaacatactttagtttcataaagattttaaataaagtgccttcaaaagcgaggagtccaagcttttgaaggcactttatttagttggcgttgttttttatatgtctcttttctttttaagtggcacaataattgtaaattttctttaattgattctctatgcaacctgaatctagttcagtatataaaaactagtttcgtttgcttcactgtcagaaattctccttcgcttcttttagattatatacaaggtatctctaaagtccttttagttgccaaaatttaataacaaataaagtataatgattatagcttctctaatttcactttatttaattgtagacattatttttaaataacaaacataatcattaaaaaagtttttgccatatcctcaagtacttgttctagcacaatttgagtgtaccataaatgcctttttatttttctaacttaattttacaattcgcgttatttgattttcaatgtcaaagcattcagcgctacgactaccgtacttaacgacatcaagacagcaccaactgctggacttaataggataccaattggtgcaagtattccggctgctagtgggattgcgagaatattgtaccctgctccccaccagaggttctggatcattttctttcgcgtttgcttagctaaatcaaggaaatgcaaaatatcttttggatcgctgtttgtcaagacgacatccgcagaatcgatcgcgatatctgttcctgcacctattgccatcccaatagaagcacgggctaaacttggcgcatcattgatcccatcacccaccatgattacttttttcccttggtcaagatatttctggacaacagcttctttatcatctggtaataaaccgccgtaatattcttcgattcctaaataatctgctactgcttgagcagcatttttattgtcgccagtaagcatgactggagtgatttttctttccttcaatgttcggataaactcttttgcttctgtttttactacgtcacctaaagcaacgattgcagctagatgattttctaaaatcaggaagctgatggtattcccttgttcttggtaaggtttcaataatgcttgttctacgtttaatccgagacgctcaacttctttttcattaactattttcacttgttggtttttgactgttgcctctagcccaactcctgaaagattttttagattttcggcttgataaggcttgatttcatgttctttcaaataattcataatgccaacagccaatggatgattggcattcgcttccaatgctcctaaatattgaaggatttcatttttattgaacgcatcatcaagaacttcgacacccgttaccgtaaattttccttctgtcagtgtcccggttttgtccagcatgatcacatctagatcattggcttgctctagtgcgttgcggtttttcaaaagcaatccgtttttagcggcgatcgatgtggaacgagcaacaactaatgggatagctaaacctagagcatggggacaggcgatgataaagacagtgaccatacgttccaatgcattaggaagatctgtcaagaacagccatgcgataaatgccaagataccgacaattaaggcaacataaaacagccattttgccactttgtctgataatgactctagcttggatttttctccttgtgcttttcgcaccatttccataaccttagctagatacccattttcaccagttccagttacttcgatttcgatcgttccatccccattgatagaaccgccgattactttgtcattggctcgttttttgattccttttgattcgccagtcacagctgattcgtcaacgattgtttcacctttcaagataacaccatctgttggcattttgtcaccggaacggacgatcaaatgatcgccttcctttacttcttttagtgagactgtctcttcttttccttctttcgtcaagcgtttcactgattctggcagtaattctgctagtttttgtaaagcattgctggcattcgaaacagcgttcatttcgatccagtgacctagcaacataatgacgatcaatgtagctaattcccagaagaaatccatgacgtgcgtatgaggattgatcagattcgcgataaacgaatagacactataaatatatgcaactgtaatccccatcgcgatcagcgtcatcatagcaggacttttttgtttcaattccatttttgctccgcttaaaaatggctgtccgccatagataaatagtatagttgctaagatcagtatgagccaatccgaaccaggaaatgttatttggaagggaaattccattcccatcatcggtgaaaaaagaatgactgggatagctaggataagcgatagccaaaatttttgtttgaaattccccatgtgcatggaatgatccataccgccatgttcgtgatccatgtgcatcgaatggtccatttctttgctgtccgctatatctccatggttatgtcccatatgcattgaatggtccatctggctatggtcatgcttcatctccatctgtttttcgtttgaatgagcactttctttgtttcctgcttcttttttatgctcctgttttttctccatatcgttcccgttcatttttactccatcccttctcttactttttcatgtgccgatttaagctcagggagttcaacaatacactgacggaactaaacgccatcgctcctcctgcaatgattggattcaaaaagcctaatgcagcaaaaggaatgccaatcgtattatagacaaaagcccagaaaagattttgtttgatttttctcaatgtcattctagacaactcgattgtttgagcaatggacgccaaactactattcatcagcgttacatctgctgtttccatcgcgatgtccgttccacttcccattgccataccaacatcagctaatgcgagagctggcgcatcattgattccatcacctgccataccgacttttttgccatctttctgcagtttttccacataggctgctttatcctctggaagtacttcggcaaagatgtgcattggatcaatacccacttgtttaccgatcgtttcggctgccagtttgttgtctcctgtcagcataaagacatctaatcctttatcctgtaactgcttgattgcttgtttggcttcttgtttgatttgatctgccacggcaatcagcccgatcacttgcttttcatcagctaaaaacatgactgtttttccctgctgttctaattctaacgcgtgttcttggtattcatcaaatgataggttcaattcaattaatcgtttacgtgtacccgcaaaatagcgtactccgttaatcgtaccgctgattccagcacctggatgagctgtaaaatcaatcatatcgtatgttgctgcttcttgcagttttccgtattccacgattgctttacctagtggatgttcagaagcttgttctaaagtataaaaaatagataggacttctttagaaccgactagatctgtaactttgggctttccttctgtaatcgttccagttttatccaaaacaatgctgtctaagtgagcagctgcttctaatgcttctccgcctttaattaagattccgtttcgtgcgccaacacccgttcctaccatgatagctgttggagttgctaaacctaatgcacatggacacgcaatgactaatacagagacactatggatcaatgcaagttgccaatcacccgtgatcaatcctgtcgccactagcgtgatgaatgcaatgactaaaacgatcggaacaaaaattcctgagattcgatccgcgattttttgaattggtgctttgcttccttgagcgtcttccaccatttggatgatttgagctaaaactgtctgcttatcaacttgtgtgactgccatatgaagcagaccattcgtattgattgttccgccaaagagtgtgtcatctggattcttttctacaggaagactttcgccagtaagcatactttcatcgatcgcactacttcctgaaatgattcgaccatctgctgggatctgctcaccaggacggatgactagctgatcgccaacgacgacttcttcaatcgctaacgtttcttctttaccgtttcttattacttgagctgtttttgtttgaagagacatcaattgtttgattgcattacctgttttcgtttttgctgtatgttccaaatatttgccgagcaaaatcaacgtgatgatcatactgctgctttcaaaataaagatcttggggatgtccacggaaaaatccgttgtaaatgctcaatgcaaaagcagctgatgttccgattgctaccagtacatccatatttggtgctttcgtcttgattgcatgatatgcccctttataaaaacgagcaccaacataaaattggacaggtgtagacagaactaactgaacgattggcagatgaaaaaagtgaacaattgccgcatggctccccaacatcatggcaatcattgacagcatcaatggcaaagtcaaaatcgtactcaatacaagatcgaatagcatttttttcaaatatgcttgcttttcttccgcaattttttgtttatgggcttcatcgtacaaaatcgcaccatagccgatattctctacgctttggattaatttttcagtggtcgtcccttcatatttgacacttgctttttcagtggccaagttgactgtggcattgacaacaccaggttgtccgttcagctctttttcgatcctagcagaacaatttgcacaagtcatacctgtaatgacgaatgtgtccattttggtttctgctgctgccatcaaatcacctctgctttatatcccaatccattgattgcttgacagatcttttcggattggacttttgtttcatcaaacttgactgtaccgtttgcttttttcaagttcacttttactttctgtacgccgtcaagtgcgcttaccgcttcttcgactcttgcaacacaatgattgcagctcataccttcgattgaaaattgttgtttcattttttcttcctcctattgatgttgtttacattcacattgacctgggatacagttacattcgattgtttcgactggttgcttttgttctaattgtttcaagatttcattgatatcttcttgagtcaaagtagcttcttctactagatccgcaatcgtctctccaatcctttttgcacagatatgggaaaaaagattttccgtcgcactacgaactgtttccatctctgagacagctggatgataaatgaatttttttccttcttgttctgtccagatcacttctttttttaccaaacgtcccaacaaagttttgatcgttgctggtttccaatccatcgaatcagctaagatctgcgtgatttcttgagcagtcgtctgtccaagtgtccaaataacccgcatgatctcccattctgaatcgctgatttttaccggcgttttgactttctccatttatttcacacctttcgtttacaaatgtaatcaataacttatgaatacagattacacttgtaaacaaaaactgtcaattatttttgctctctattttcaatttagttaaaaattcttgtttttcccctcttgttttaaggatgatcagtttgtttcgtgcatggttttcttggatcagctgctgtattttcggttcattgttttcttcaaaatgccagataaaagataaaaattctacgtattccctatttagtttctctgtaaatgcttcaggcatatctggccgtgtttttttgtttatctttctttttaaagaacgccaaactactcggtagatggcgacataacgcggcactttaagccaaatgattctatctgcttctttgattctctcttctaacgtagaagtataatttccttcaacgatccatgacggattagataccataaacgtttgttgttcttgcaaaaaccactgttttgcctgaatactgtaatctgttgtatgccataaaaggtctagcggcagtagcggaaagcccgtgatttctttgatattccttgcgagggtcgattttcccgacccactttgtccaatcacgatgatcttcattttcctccctcacttctctttggaatttggttcgatcataccatttataacgccacaaaaaaacaagagttggctctacacgccaactcttgcaagaagtaattttattttaaggctgaaccacagtttctggctcagtgatttctttatttttgtctcgacgagcgatggccggcaagatcatgcctaataagatcaagacgattggtgtgatgatattcgtgaatagctggaaccaccatgctttaggatccgcagtataatctacttttggtaccattcctaagatacaggcgaacgcagtgaaggcaaagcaccaagcaccgaagataaacccgatttttggatttttgacaaatttatattcagaattgaatttcttataagctttattcaacatcatatacgccaagaatacccataggtaacgcattggcataacaactgagttcaagttcgtcaaccatttaactaattcattcatatctttgataccgaagattggcagcaaaataatgattcctactaggatacctgtcaaaagatagccgtttactaatgtacctttatgactacgtttacgtagccagtttggtacgaattctggatctgcatctgctaacaagatttttaacggtgcatcgattgaaaaggctaatgcggagatttgcccgatcatatttgtcaatgcgtaaataatcatcaatgagttaccgataccatagtaattacctaaaatttgaaaagcactgtatgccccatttgccatcaagtctttagggatattatcgctagcaaacagcatgcccattgcgactgaacctaatacagcacaaatccctaccattgctgctaagaaaatcatccctttaggaaattcttttgcagggtttcttgtagagttgacataaggggatattttttccgctcctccaactgcaaacactaacatagagacggttgtgaaataactgaagtcaaaggttggaatatatgttttcacttgattcatatgcggtgtggcaaattccatcgttgggttgatgaacggtgccgttactgctaaaagaataaataggatcgacataacgaacatcgctgttccggctaatccgccgatcactttcaacgtagaaagtccttttgttgataaatataaaaaggcaagaaatataataagtgaaataactgctaccatttggactgacatcgtatttacgatatttccgtttccttggaccgcccaaccccctgcaatcaggatggcttgaggtttttgtgccaaataaggaatatgcacgacccagtaagtccaagcagcataatatgccagccgtttattggatgtcgtattttcgacccatgaactgacgcctcctttactatccttgaaggctgatcctaattgtccaacgatcaatgcgtatggaatgaaataaatggctagaatcaatagccaagaggtgacaactgatactccttgctgggcatagttattaactacattccccatgccccaaaccatgttgaatgcaattaacgcaacagtgaaccagcgtaattgtttattgttcattcgttctctcctttataataaaaatttgttaaccaaatgtaatcatattcaatttttaacaaacttacaagacagcgttattttatgtgtgtattcttttatttaatacacatcattttttcatattttttccatcaaaaaaaggagttgttttctttgatttcattgattttattgtatttaaagcaattttgaattttctgcaaaattaaaaacatcagttattttataatcttagccattttctttgtattcttttattaagaaaaaggtataaaaaaagaggacgttcattcgtcctctctactggtcaatatttattttttacatgtaagcttcgcatggcattcaaaacagctaggactgttaccccgacatctgcaaatactgcatctcccattgttgcaaaaccaaaagcacctaaggcaagtaccaatatttttatcccaatagcaaaaacaatgttctgcttgacgatcttcaatgttttctttgctaaccggatcgcatctgcaatcttcgatggttgatcgttcatgatgactacatctgctgcttcaattgcagcatcgcttcctaatccacccattgcgatccctacatctgctcttgctagcaccggtgcatcgttgattccgtctccgacaaaggcagtctttttattgcttctttgtaagatttcctctaaccgctgtactttatcttctgggagtagttcactgtatatcttgtccacgccaacttgcttcccgatatgatcagcgatttttttcgagtcacctgtcaacatgactgtgtgcttgacaccagcctgttttagttgaaccaatgcgtctacagcatcttctttcaaggtatccgcaatgacaagataaccactataactttggttgattgctatataaagcaatgtaccgatttcttgacttgaaggaaaagagatttcaaacctttccatcaatttgtgattacctactaatatttgtttgctgtcaacttcagctaagatcccttcacctgcaaattcttggatatttgttgccggtaaaagcggaccttcgtaaccttctaaaacggattgcgcaatcggatgtgtagaaaactgttctgcacttgcaacatattgcataaatttctttggatcaattcctgttggatcgatcgtctggatcgaaaagtcgcccttcgttaatgtgccagttttatcgaataccactgtctcagtttgtgcaagcaattccaaataatttgaaccttttattaatacaccaattttacttgctcctccgatcccaccaaagaaactaagtggtacggaaatcactaatgcacatggacatgagatcactaaaaatgtcaacgaccgatagatccattcagaaaacgccgctccagaaactattggaggtaaaacagccaataagacggccagccctacaacgactggtgtataatatcgcgcgaatttggtaatgaaattttcagctggtgcttttttgctgctggcattttctactaattctaataatttactgatggtagaattttcataggatttttctacttgaactaaaaatggtttatttttattgataaatccacttaatactgtttcgccaacatatacagatttaggaacggattcacctgtaagtgcggatgtatcaactaatgattctccttcgatgatcgttccatctaacggtacacgttcaccaggcttaacaagtacatactgaccaatctgcacatcttcaggattcacggtcatcaatccttctgctgtctgtatgtgcgctgtttctggacggatagccatcagttcacgaatcgattttcttgaatgattgactgccaatccttggaaatattcgccgatttgataaaatagcatcactgctacggcttctggatattcaccgatcaacatagcgccgattgtagcaacagacatgaggaaattttcatcaaagatttgtcctttgacgatattcatcaccgcttttttcactacatcatatcctatcagcagataaatcaataaataccctatcaaacgaactggttcattaaaatcaaataatagcaagacagcgatacctgcaagtgaaaataaaatccggatcagcgtgtttctctctttttcatttccatgttcagatactttttccttgtctatttctgttaccttgacatctggttctaattccctcactactttttttgtttcctgttcaaccgcagctaatcggtcttcctctacgtcaatcgttagttttccagaagtgaaatttaccgttgcttccttgactccatcgatttgctggactcctttttcgattttcatcgcacagttcgcacagtctaaaccttctaatctgtaacttttcattttaatgacctcctcgctttaacatatgaatatctcttcataactgattataaatgaatggttattcatatgtcaaggtatccgaaagaaaaaatgagttttcaaaacataaaaagaaccagatcaaacacgtgatagttgtgtttcatccagttctctcgttcatataacatgtttaggacactcttttagaacatcctgacttatataatctctgcaccaaatggcatcaacgccaatcgagcaagtttgaaagattgctttgcaaatggtatccctataatcgtgatacatagaaggatgccgctgacgacatgtccaagagcaattgggagacctgaaacgatcagccagatgatgttgacaatcaatgacatgccggactggtggtaaattacttctttgccaaaaggcgcaaaagaaagggaggcgattttaaaacactgcataccgatagggataccaatgatcgtgatacaccaaagtacccctgctgctaaccagctaagacccccaattagtccgccaaatatgaaccagatgacatttcctaaacaactcattgtatttctccttttattactgtttttaattagaactagaactggacaaaaaacgatttgatttttcgttttttagcttccagcatcaagtattccgcaaatcttttttggatttcttccgttttttcttttgttactaatgtgtgttggattagttttcctgctggtcgctgatccacccgttcttctgattgctgttcatctgcttgcgcaaaaccgatgatccggttttcttttgttacagcaacgatcaatagtttattcctatcatgtagttcagctgccgtttttacttttacgaatgattctggatgatcagtaatcagctgattgatttgagggagatcttcttttactgcccttcgtatttccatcatttctcccttttctttcgttcatttttatttccactaaaaaaatcaactgcggaaatcgcatctatccaactttgtgcaataatctcgtgtccgccaatcgttggatgcacgccatcttcttttgtatatttcgaaaaaccataagcgattcctaaagcattgaatatcccatctaaaggaatcagcaatgtgccatattcttttgcgagtttacgaacggtttggatcttagggtctaagtctttgcgccacccataacgatcatttgtcacaggaagtacaaaaggctccattaagacgatattgcagattccagctgcttgaagttcatttagtaactctcgataaacggattcaaattgctgcacagatttctcagtgccgaatatagcttgatctccagtattatgccacgtatcattgattccaatcaaaatcgatacataatcaggttgcagagctaaacaatctttttgccagcgtgcttgcagatctgcaattttgtctcctcctatcccacggtttatacattcaaattccatcgttggatattgtgagattagtttcccggcaatcaaaagcggataccctttacctagatccgttgcttctgaacggtctcttcctgcgtctgtaatgctgtcaccaataaataacacgcgtgttttcatttgtcaaaaactcctttttgaataaaacgacgattttcttctttatattatcccataagctctaccaagacgaaagcgaaaatagatgtataaaaaaagacacccgcctagtttcctcaaacgattggatgaatactcagcaagtgcctagttttttatgcttttttcttaacgtgccggatttttcttgattccttcgttgtttgattcagtgaaatcgatcagacctaagtttccgtcaatcagcccactgtcgcccgtcaaactcaaaatatgacgagaagcatcaaaacgtatattcatatgctcatctaagtctgccaacgaatatccctttactaatatctctcctagattgcttgggatagattggtcataactttctgtcgacatatctgatccaatgattccaagggtgaattgaacttgcatgtggatcattgcatgctgagaatacggacctactccatcttcgaatgttaatattagtttgttttcaggtgctagatgctgctttatttcagcagcagaagcatcatcaaatcggatctccatttgaatcgccttctttgtatatgttggattgattgcgatttcattatagaaccttgtgaatcaaatagcaatttcttttgctttcttctcttgtctgctggaaacttcctttatcccgtattttaaaaaagaactgcgagagttcgcagttcttttttagaataaacggtgttcaaaagccagtttctcggtattaagccaaatttatgcaaaaatgtggaaagccattttcacaaaatttttcttaatactcgaaactaaacagctttttcatcacttcttatggataaattcggttcaacaaacgtgggaatggaatagcttcacgcacatggtcgataccagcaatccaagtgactgttcgttcaagacctagaccaaaaccagagtgcggaacagaaccgtatttacgtaaatcaaggtaccatgaatattctttttcatccaaaccgtgattacggatttgttctaacaagaaatcatagtccgttgcccgttcgcttccgccaatgatttcaccgtagccttctggtgcgatcatatctgcacagatcaccacgtcttctcttgttggatgtggtttcatgtagaatggcttgatggcttttggatagtttaggataaagacaggttgttcgaatgaatttgcaatgaacgtttcatgaggtgaaccaaaatcttcgccccattcgatgtcatcaaatccatttttcttcagtaattcgattgcatcatcgtaagtaatacgagggaatggcaattttgtataagtttttaagacttctttgtctcgtcctagtacatccaatgcgtattcgcaatgatctaaaacattttgtactaagaaggctacatattgctcctgtacttctaaactttcttcttggtgagtgaaggccatttctggttcgatcatccagaattcaatcaagtgacggcgtgtctttgatttttcagcacggaaagtcggaccgaatgaaaagacttttccgaaagccatagcagcagcttccatatataattggccactttgagataaataggctttttgatcaaagtagtttgtttcgaatagatccgttgtgccttctggtgctgaaccagtcaagattggcggatcgattttgacaaaatgatgttgattaaagaattcatacgttgcacgaatgatttcatttctgatttgcatgatcgcatgttgtcttgaagaacgtagccataaatgacgatgatccatcaagaaatctgttccgtgttcttttggtgtgatcggataatcgtggctctcgcttactacttccacatttgtaatcccgatttcataaccgaattttgaacggctgtcttcacggatttctccagttactagcacagatgtttcttggtgcagatttttagctgtttggaaaacttcttctggcacttcgctttttaccactaccccttggaagaaggctgttccgtcccttaattgtaaaaatgcgatttttccgcttgatcgtttatttgcgacccaagcgccgattgttactgtttctcccacatggtttttcgaatcgatgatttgaatttgttccacgtatgactctccttttatattccttgaatttcttcaggattaattttgacttttactctcaataaattgcttgattctgcgtaccgcttcttctaacgtagcacgatcagtcgcataactcatgcggacattctctggtgccccaaagccttcgccagtcacaagtgctacccctgtttcttctaaaagatcttctacccattgtgtgacattctcatacttacacatgcgtagcgtttcttttacattaggaaaaagataaaaagctccttgcggcttttcaagagaaacacctggcagttctgccacaagcggatataacgtattcaggcgttcttcaaaggcgttccgcatttcttccactgtatcttgctcacctttcaatgcttcaacagctgcatattgactgactgctgtcggattgctagttgattgggaagcaacagcgatcattccattgataatttcaggattcccaaccgcataaccgatgcgccagcctgtcatcgcataggtcttagacacgccattgatgatgatggtctgatttttgattgcttctgaaatcgttgcaattggagtaaactcattgccattataaactaaacgaccataaatatcatcagcaactatcaaaatatcattttttactgcccattcaccgattgcctgaagttcattcttgctataaatcattccagtcggattcgatggagaattgatgattacggcttttgttttttctgaacgtgcttgttctagctgttcaacagtaactttccagctattggattcttcccctttcacaaagacaggaagtccttctgccagttttacttgctcaccataactgacccaataaggcacaggaatgatgacttcatcttgcgggtcaaggatcgtttggaaaagggtatacaaagcaaatttagctccgtctgttacgactgtttgtgaaggttcatagacaagtccatagtttttcttcagataatcaacgattgcctgtcgaagctctgggattcctgctgttggtgtataatagctagctttcccgttgcggattgcttcgattgctgcttcttggatgttttctggtgtcgcaaaatccggttctcccacagtcaaactcagcacatctctgccttttgcttttaatgccttggcctttgccgcagctgccaaagtgacagacggttctaatcgttttgttctttttgataactccatcccattcattcctttaccttttaaattcccttgattgtcttgacttcatctccagattcaaagccaatcaggtaataattcagtttcccatttgtttcttttcctactacttcccacacaggctgatcatcatacatccctaaagcagctttttcgatttggatttcaggatgggccgcagcaattgtctgttttgcttcgttttcagtcagtccctttgtttgatccaatacttttactttttcaccagatttaggaatgataacggcgatttcttttcctttatcatttgtacctgtcagtgaaaagtatgtcttctttcgagtaaaccaataaaaatgatcggtttcctcaagatttgcatatttctttgcgatttctactgcttctttcttcgcctgcaccgccggacgactggaacgcaagtaaaaaatcgagctgatcacgatgaccgctaataaaaatacgatcaagccaagtaacacgcgattaatcgttttttcctttgtctgttttttcttcaagggtcgtcgctcctttatcttcattccttttcattatagcagattttaattatgaaaaaagacagctcctctaacttccttcttcatttttctttaagaattcatggatatcctgatagatttcctccatagctagctctttgatcggtacttttttcggtaatgcatggatgatccgtgcgccatattttgcagtgactagtcttcgatccaaaataagcaatacgccacgatctgtctccgtccttatcaagcgacctaatgcttggcgtaacttcaaagctgctttaggtacggattcctggtaaaaaggattgatcccctctgattctaaataagcgttcctagctttgaccatcgggcgaagcggattatcgaagggtaaacgtgtgactacaacgatctgcaaagcatctccaggcaaatctacaccttcccaaaagctgtcagcgccaaacaatacgcttttttctgacaaaatgaagcgtttcaaaagcttctcccggcttccaccaaacccttgagctagtatttctcgtcctttttctagcatagacagatgcattttctgatagaccttctgcaaaacatcatgagaagtgaataacacaagtattggccgatcttcttgttcgatcagacctgtaagtgatgtctctaaataatcgatatatgcttgattgctgacttgatggacggcaggtgcctcttttggcacatagatccttgcctgtttctcataatcataaggagaggcaatcactttaagaggtgctgcttcaatgccaagccgcttagagagatagtgtcgattagggccgatcttcaacgttcctccaatataaagaatacgatcatatcgaggataccaaacagtcgacggcaacatagccgcttgaaaatcatggagatgaaaaatcatctgctgcgctgtgttcccaggaacgaaccaatggatcaaatgatctcgccagtcttccagccattgatccatcagcaagtattgcttgtctaattgatcaaataagctatataaacttgctaaatcgatccgcatctggttggtccaactttcttggataatctcaaaagtcaagcgcatctgtgattgtagttgttggatctcttgataaaaaagttgcagatgatccattgctgttccagattccagtggcagctgatccaacatttcttttgtcatcatgacttcttctggatattgtccgttaggctgcttgctgcttactaagttcattaatccctctgccacacaaatctgcgcttcgcatagtgcagagagttcttctcgataaatcgacaaccagcgcaaggcttcatgttccttcggcaaataactttgtatgcggtcaaataactgattcggctcttccagttgttggatttgtttatggaagtagttaatacttagtcgtttgtcatttactttttcagcaatttccggcaaatgatgcacttcatcaatcaacaaataaggactagctggaagcaatggttcttttcgctgtgtttcttgtactaaaaatgcatggttgactatcaaaaaattgctttgtttgattttcttttgcaagaaacgcacaaagtcttgtttgtaaaacgactgattccttgctaaaaactcagtgcctctgtgcgcgacatctgcaaagaatgcatggttcagattggttaaatgtaattcatccaaatcaccggtcttcgtttgtgttagccaaactaagacagccatttggtacaacgcatattgtttttgtcccggcggttccacaagtgtacctttaaaacgctgtaaatcaatatagtggcgatagcttttgataatcacaggttgtatcggctgatctagcaattgattcagtaatggaatgtctttttccatgatctgctgctgcaaaacaagcgaaacggtgctgatgacagctggtttttcaggtgtagccaaataactcaaaggcaacagataaccaatcgttttgcccattcctgtagctgcttcgatcatcaaatcttttgattcatcttttgtgaaatggtcgtagacagcattcatcagcctgttctgttcttttcgatacatcagtgttttaccaaacattttttcttttgcttgtttttttcttggatatgtccgctcgccataatggacggatgtgaatagctccacttcttttttctgcaaagctagcccatcgatgatttctaatgagagatcaaggggctccgggttttctttcatttcttcaagcacgtggtaaatgaaacgactcgtatccattcctgtatggctacttaatcgtgcaatctgctctaatgtgatgatcggcaatttcctcattcgttcttcgatcagtaaaagaagctgacctgtcacttcggcatcactatccgcctgatgaggattctcatgaataaagccaaggctttctgacaaatcagctaagcgaaaacttggttccgtcggcaagaaaatttgtgcaagttctacggtatcgatgcccggtatcttcaaactaggaagtccacatcgcatgagttcatggttcaaaaaattataatcaaaataaatattatgcgcgacaaatatggtgtctgccaaaagattgtaaatcgtttgggcgacatcttcaaaataaggcgctttttggacgcgttgattcgtgatccctgttaaatgctggatttgttttgaaatcttccgccctggatgaatatcgatcgaaaaacgtgaagtgatccgaccagcttcaatcatgacgcagccaaattggatgatccgatcttcttttggattcgtcccagtcgtctcgatatcaacgactgcataagttcctggtttcaaaatatcttcctcttctcctgcctctaatgttcttttgaaattatactacaaagtgcagaaaaatactctcatcgctttttaaggaaaaaaagacaaaaaagcccagacacataaatgtctggacttttatttttaatataggtaaattaagctttagtaacgtttgttgcttgaggtccgcgttgaccttcttcaacatcgaaagttactgcttggccttcttctaaagttttgaatccgtcgccttggatagctgagaaatgaacgaatacatcgtttccgttttctgcagtgatgaatccaaatcctttttctgagttaaaccattttactgtacctgtttccataataaaaatcctccttgtgtttcaacacataatttgcaattacttgaatggtgtatatctggaagatgtttatttgaaacaagctaccacagattaccgaacaaaaactacttctacagtatatcataccttttacaaaaacgctagagtttttcgatatttttttataaaaaaatgttttctcagcgattacatcaagtgaaaaaccgaactttcttaatgacaaatgttttattgttcagataaccctctttcgatcctttgcacctctttaaactaaaaaaattattctgtctgactatttattgtttctgtttcaacggttgaagatggggaagactctttagtaggtctgatgttctcatggtatttctgatagcctatgacagtgaccagaagaacaaggcaaaccaatacgatcaacgagattaatttttcttttttgttcatacctatacctcataaatgacaggatgatgcccatcctatttctgagcatgggtaacagcaaaagctgcagctgttgaatggaagaaatgccagcaactttcgtaatcacatgacggacaataccaaaaataaccaaaccttggctgcaaagcccgttcttctgttttagggaacgcagaatcaaacgctgaagtctgcgcataaatatttttgtacatacgtgcgcctgtgcttagagaacgctgtgtttcttctgcaaaaactggttgacttgttaaacttagggatagagacagcaaacaccataacagtctttttttcataaagacctccttatcgataagtttttcccaattaaaatcatatctcaagaacgaccgttatttgcatttcattcataaatggtgttttttgtatcataatcgtcaaaaaagaggtcgtgacgatgtcacgacctcttgataaacgatgttccagaagtaacttcttcggaaataagccgaaatttcacaaaaatttgagaaataattttcgtaaatctcttcttatttcttgatgcagaacagcttcttctctctaatactcaggtcaaaacactgatttcacaacctcttttaataacgaaggattgctgtcagactcttttcatctggcgcatctttttgatccaaaataaacacttttccaccattaataatcacatcgtctgccaaagcattcagcacttgacgccgatcatattctgtttcaggatcttctccgaaaccatcagctaagtttgacgtagcgataaacaaatgggatacttttccttctttcgcagctggaacgatatcaactaactgatcgatgaattttttatctaaaagtttattgtactcttttgattcttgggctgctagttcacttgacagcttcttcgctccttcttcgatatctctaaaggatagttgtgatggagaagcagaaatcgcaacgtctgcacaatagtaaggatttttggcgatttttttgaacatcgtctgattttctggtagagcgaataaataaatcggccattgttcaggattttcgaaagaatccttcaagtacgtatcaactgcttggtaatagttgacccaatcgatctctacttcttcatcttttggattcacgccatggaaagtcacgccatctcgggcaccgccccctccattagaagagaagttcaaaccgccacctgtcagttcagatcccaatgcagtaacaacatcgaccggtgccccttctggtagagacacttcttttacttgtttgttgctgacttcatacaatttcatggagtcgcggttcaatcccaacagataataggaatagttgaactgtccatttttgataatggccagtaaataaggaagatcacttacataatattgatcgtctaccgggatactcaaacggtggatataggtttgatcagcagttataatgactgctacactcgtagttgcactacgccaaaacgaaggatctcctaacaaattttcaattttttcttggaacggggaccagtcatgctcggaatattttttttcaaaacgtttctttgcttcttttgcaaaatttttgaatttgatttgatctttttccacatcttgatgtgcgacatgcgtattcagcatgatcgtgacgaacggtcctttagcgccttctgaagtcaattgtgacaatagttctttatccttttttgccataaacgtacccctcctaaaaaaatcattcctttgtgtctatctaaagtctaccacaacactatttttccatacaataaaacgtatctaaaaaaataaaacggtttctttagttgggtattttgcaattttttaagttatcttcataatttcctcaattatttaggcacagtcttcaactattcttcatgaaaggctgttagactaagaaaaagaataaaagaggtggaccttatgcatttgattatgatttttagtttattaagtatcatcagcttatttgctttcagcgcttcccgcttattagaggcggaaacacagcctgtccctgtaaaagtacggaaaaatgaccgctaaccttttcataacgcgcgttcttatcctaaagtttttttcagaaacattgaaactctcttccctctctgataaaattttaatttgtagcgaaacaaattaaatacaaggagatcggatatgtccataaaaaaaacacgtctagtcctattattggctagtctcattctttgccttgcttcttttctaccagctgttgctgtgcaagctgaagatacgttcaaagtaaatgcaaaagcagcttttgctgtagatgcgcaaagcggtaagattctttatgatcaagatggagaaaaaaccatggggatcgcttcaatcacaaaaatcatcggtctttacatcgtccttgatcaagtaaaagagggaaaactatcatgggatgataaagtttcgatttcagattatgcagaaaatttgagtatcaccccagatttatcgaatgttcctttgcataaagaaaacacctacactgtcaaagaattattcgactctgcaatcatccagtcagccaatgcttcaatggtggccttggcagaaaaaatctctggcagcgaagctaaattcactgaacgaatgaaagaacaattgaaagattggggaatcaaagatgcaacgatcgttaatgcatcaggattgaacaactcttatcttggcgaaaaccgaccagaaggcactggagaaaacgacgaaaatcaaatgtctgctcaagatgtggccatcgttgcccgccatttgatcttggatttcccagaaatactggatgtatcaagtactacgacccaaatgtttggcgaaaatacgcaatcaccagtggaaatggtcaactggaactggatgctcccaggattcgttaattacaaggaaggcgtggacggattaaaaactggtacgactgagcttgcaggtgcttgtttcgttggtacgatcactaaaaacgatcaacggatcatcactgtcgtattgaatgcggacggccatgcggaaaacccgagtgcccgcttcaatgaaacagaccgtttgatggactactgctatgacaattggtcagaaaaagagctcggaaaagctaacgcaagtattcctagcctaaaaaccattgatgtaaaagacggaaaagaatcaacagttcctgttgtgcttaaaagccctgtaaaagtatgggtacgaaacgatatggatactggcaaattaacgatcacgccaacacttgacaagaagcaagtcactgacaacgagatccaagcacctatggataaaggtacaaaaatcggtaccgctacgatcaccttggcagacgataaattaggttatttagaagataacaatgcgccatcgacagagatcattacggataaaacagtggaaaaagcgaatatgttcgtgattggctggcgacgcgtcgcagaatttttcggcaacttgttttaattgaacaataagaaaagcatctttccatcggaaagatgtttttttgctttttctagtttaataacagctttttccatctattttcgttatactgtataagaaaaaggagttgaatttatgaatctaaccagagatctgatctttttagttctctatcttattggggtattctctatcgtttattggcgaaaacagaagaaggatccttccttgttcttttacggcagtacgtggacatttacggtaatcttaacttattttgtcgtgttggaaattttttattcgaccttttattttttgattccattgttgttctttagtatctttgctttttcttatttcacagaaaaacgaaggctgctgaatggtcttttattcaatgttttcctcatcagtttcggcatctacttgtttgtcttgctgtatgaaacgcaaaatattttccttggcggactgatcgccttgatcacgattccattgctacttgtccttttatttggtatttatggattgattgtttttcttttttggaacggggtcacagttttacgtagagaatcgcattcattagctaatcttttaacgttgatactagccatttttcttacactgtttcttgtttttgactttttcttgttaaaatatttgccgcaatggataaatgctttgtttttctgcgttcccctgatcttgatctatctatttatcgtattctacaactttttgactgtctcattcttgtatcagttcaaccggcctcgatacaatcaagacttcatcgttgtgttaggcgctgggttgatcaatggagaaacagtttctcctcttctagccaagcgaatcaataaggcgattgctttttatcgggctcaaagccgtgctacattaaatccgcccatcttattgatgtctggcgggcaaggagcagacgaaaaagtaccagaggccattgcgatgaaacaatatgccatggaacaaggaatccctgaaagagacattcttgtcgaaaccaattcgacaaccactttggagaacatgctctattcaaaggaaatcatggatcagcaaatgaaagggccataccgcgtgatctttagttccaacaattaccacatttttagagccggtctttatgcgcgtcaagccaaattgaaagcaaatggtattggtgcaaaaacagctttctactacttgcctaatgcgtttttaagagaatacatcgccatcttgatgatgaacaaaaaaagacatatgatcatttgcggattgcttttcgcaggctccgcattcttatcgctgattactttacttttctaaaaaaacaaggtgtgacaaaacatatgtcacaccttgtttttttctttcattctcttaactattggcaaaaagagtatcccttttttgaccgctacttgctgagcagaataaataccgctgttgcctgaacacataaagctgatcaagcagatcataaagaagtatactgcagcttgtgaaccgaacaattcgatccccatcacaaaacaggcaatcggtgtatttgtcgcaccagaaaatactccgataaagcccaatcctgcaagaaaaggaacagaaacatggagcaaaggcgctagtgctgcaccaagcgttgcaccaatttcaaacaatggtgtcacttctcccccttgatatcccgcgcctaaagacaaaactgtgaagaataacttcccaataaaatcatagacatgtgcctgtccattaaatgattcttgaagtaacggaagactcaatccgagataacgttgtgtttgcaaaatcaatgctgctgccacaactacagctccacctatcgtatttcgccaaataggatgaggaatccattgtgcatatcgcgcttttaaaaagacgatcgaacggctgaatacccagccaatcaaaccaaaagcaatcccagcaacaaaaactttgaagaacagcaacatactccattcaggaatcacacccatttggtaatgtagatgagaaacaccatagctttctgtcatgaaatttgcaaacagtgcagcaaagaagctagggaagatcgcttctgttcggacttttccgattgccaacacttctaatccaaataatgttccagctaaaggtgtgccaaatacagaactaaaacccgcactgattccactgataatcaagatttcccgttctgatttatccaatcggaacaaacgtgctgtattatctgctaacgctccccccatttggactgctgttccttcacggccaacagatcccccaaataaatgggtagttatggttccaaacagtgtaagtggaataagtcgcaacgggattttttcttctccaccatttccttgatcgatcactaagttgtttccacgactagaaagaccgccgtgatacgcatagagataagcaaaaagcgcaccactaactggtagtagataaaggagccaaggatgtgatagtcggatatctgtcacaactgtcaagctatttaagaaaaaagcagataagctccccatgaatataccgagaatcgctgtgatcaccagccacttcagcatatacactaaaatgcgcattggactcggtaattgtttttccataaaaaattcctcctcaataaaaaaacgcctactaaagaaaggggctgtccccagactttagtaggcgtcattagctatctttcgttagcatttaaaggcgaacaccatcacctattcacttccattaaaagatagcatatttttctgtaaaaaacaataaaattatcgttctttctttacacgttcagcaaattcatagaaaggagccaatttcgttaactgttgattacattggtcactatcatgacaaatataattcccctttttcgtatacgtgccatcagaacctgctttcgttgtagaaagaaaaagcgaaacattcgatgttttctgacagattgcacagattcccttatttaccgttggtgataaagtaccactaatcccttttaatttttcatcttcgtaatagaccatgaattttttctgcgtacctggatcattccagccgatgtacgtatgttcttgcaagtcgatttcattccaagctggttgtttgagttttttcacttttcggaataatttctcgatttgtggtttgctaggctgcataaacggctgaacgatttgcttcagctcctccaatgctctttctgcttgcgcttttgtcagttttacgtctaaaactgtcgttaaaaatgtatcgatttctggcagttcgtgatctaatatgtctcgaatcttttcagctgctagtgcctgaactgtttgcaccgtttttggatcattgacagatgagtacgcatttaataactgttctacttctctttttataaaaaaatattggtatggttttattgtttgttccatgattttaaagtcctttcttctaaccaaagtgcatactttgtagaaaaaagtgatcttctgcaaagtatgtgttacctgaagatcccggactcttttaaataagatacgttttgcatcttatcatcaccccctttaatgcttattcttctatgtacatgattcattcgataaataaaagtaaaccgtatcttgaacagatagtcaactgcaaacagaaaaaaggactgtgacaaaagtcgtgtcaaagtcccttgtttcgaatgaatggtgttcaaaagcttgcatctgcggtaataagccgaaacttcacaaaaatttgagaagtaattttcgtaaattccttcttatttcttgaagctgaccacttctgtcacaacctcaatatggtctattattggttttacctgttaaatcgaggattctttcccaaagtaacgttgccatctcttacgcatacttgcagacatgggttgagccgcttctttgactgcgcagtatttgtccacgaatgtcacaatatatccttctttatacttaggcggtgcgatcgttgcaccccacatgtgcttcaaaatgatatctcgctcaagatccgacaaatcggtgattttttctgcattctttacagcaattcttggatggatatacgcatgtgtcccctcgtcaaatttcgtcgtacgccaatcatagtagaacagatcatgcaaaagtccagcacgcgctgttgctttagcattgccaccccatttttttgcgagcagataactatagtaagaaacactgatggaatgctccaaacgagtggaatgaacatgctgtgtgtaattcgctaattttttcactgcttctgtttctaaaagatcttgtacataagacatatattcttcgtcttcacgccatttttctgtcataattatcgatctgccacctttttgaatttcattttcttctgaaattgatttaagtataccaccagtgttcggattattctagttgctctagataaaatagctaaagcttaatagttccttaatcataaagaaaaatgataaagaacgatccctgctgcgactccgacattcaatgattccgcatttcctttcattgggatatatacgttctgatcagtcaaagacaagatttcctgacttactccctgaccttcgtttcccatgattatagcgaaatcctctgttttttctactttgtctaatgcatgtgcttcttcatttaattctgtaccgtacaccgtaaaccctttgcctttcattacagggatcacttctgccaaatctttttgcaacacaggcaaatgataattgcttccctgcatgcttcgcagcacctttgtactataaatatctgccgttcctttacctaataaaacaccagccataccaaacgcatctgccgtacggatcatcgttcccacatttccaggatcctgtacattatctagtaaaagccagcctcctgaaaaatctggcgtatctttagatgttaacgtcatcactgctaagattccttgcggtgtaggtagatctgacatagcggtcatgacctcatctgaaactagaaaagtagaaatctctttgtttacagccagccagtctccccattctttcatacctctctgtgtcacaaaaagttcttttatttctgcatcagacgacgcagcttcttcgatcagatggaacccttccaaaagatattctgccttttcttctctgtatttctttttatgtagtttttttaattctttgattcttggattttttgctgattggatctctttcacattcctcacctcaactgattatatcatggaacaggtgcttgagcttgtttcatcctaaaaaaatcggtatcattgatttataaaacaggaaagaaaggtgacgaacatgcgcaaagttaaaatgaatgtccaaggacgtgtccagggcgtgggatttcgctatatgaccaagatggttgctgatcagttaggcgtgaccggaacggtaaaaaacgaagacgacggctcagtcacaatcgaagcaatcggaaatgacgacatcatccaaaaatttatcgaagaagtcaagaagtctccgagcccaagtggacgagtgcagtatgtggatgtccaagaagatccgatgattgaggaacgaaagaaatttgatgtggtgggataaggttgtgaaaaggtcacttagttttgagtattaaggaaaattttgtgaaaatggctttccacatttttgcataaatttgacttaataccaagaaactgacttttgaacaccgtcgataaggttgtttttgaagcgctttgcctcgagtattaaggagaaacattttcaaaatagcttctcatattttgaaatataatgacttaataccgagaggcagctgataaaacaccgtcaataaggttgtgaaaaagctggtctgcatcaagcattaaggactggttgcgaaaaagtcgcttagttttgagtattaaggaaaattttgtgaaaatggctttccacatttttgcataaatttgacttaataccgagaaactgacttttgaacaccgtcgataaggttgttcttgaggcgctttgcctcaagtattaaagacaggtagtaaaaaagctgatctataacttgcaataaatttgcttaacccatattttccagacagaacaaaaaagtttttagttttttaaataagaaagaaacacttggaatcactcttttctttctaagtatttctttcttgattttttgtcttttttcaaaatttttcgctacgaaaaagaacgaatatttatatgaaatttctatgaagttgattgaattccatgcgcttttttagtatagttaagtttgtgtaaaaattatagaagaggaagtattctatgaataaatggaaaaactggttattgggatccggacttgtcagtatcctgctctttttatctggctgtgtgcggatggattcaaacggaaaccctgacacttcaggaatcgtttatcgaatactcgtccatcctatgggccaagcgattacatatctagttgagaatttcaattggtcttacggctgggcagttattgcaatgactgtgatcgttcgtatcatcatcttgccactaggtatcagtcaatcgaaaaaaacaatgatccaatctgaaaaaatgcaagcgttaaaaccacaagttgaagcagcacagcaaaagctaaaagctgcaacaacacgtgaagaacaaatggcagcacaagcagaaatgcagcaagtatatcgcgaaaacggattgagtatgaccggcggaatcggctgtctgcctctattgatccaaatgccgatcttctctgccttgtattttacggctcgctacacagaaggtatccgtgaatcatctttttacggcatcgatctaggctcaccaagtatggtgcttgttgccattgcaggggtcgcttatctgcttcaaggatatatttcaacaatcggtattcctgaagaacagaaaaagacgatgcgtacgatgctgatcgtctctcctgctatgatcgtcttcatgtcgatcagtgcgccagccggtgttacactttactgggtagtcggtggtgtgttcagctgtctgcaaacattcatcacaaacgttatgatgaaaccacgtttgaaagcacaagtggcagaagagttgaaacaaaacccgccaaaacaagtcgtcactccaagaaaagacgtgacagaatcagcaaagccagctgacaacaaacaagcaacaaaacaaatcaaacaaccaaaaaatagtacaaataacaaaggccgcaacgcaggaaagcagcagaagcggaagtagatagtaaataagagtgtaataaaaattcattaacagttttagcaattaaaaatatcgaccaagatttttgaaaaagaaatctggtcgatatttttatttaagtgaatgtttaatttgaatcatcgattgatcgctatctaattgcagcagcatctttttatgaagaaacaactttttcttatctatcaacgtagacaggtgttgctgtttcttctaagagtgtacttaattccttaatattttgttttccttcttctaacatccaactactcgctttttcttcgcctttggtaacaaaaggtgccactcccttcgcccatgttgctcgcccacataagacaccattgaatgtcgaacctgattgttttgcaaaacgtaatgtatcttgaaatagcgtagcattgactcccgcacttaaaaaaataaacggttgttcagtcactttcgattgttcatagaaatacgcggatgcctctgcttgactataacaagtctcttgcccatatccttccacaaatctcatattcactggcacttctactttcaatacatccacttgataacgttcttttgaaaattctcgcatggcttcaataactttatgtggttttacttttgtataggcaagagaagacggatcgccaatagttgcatcataagaaaggatctctaaaaagaaaggtatgccttctgcttcgcattctgaaccaatccgttctataactatttgtttttgcacattaatctctgctggttcatcaacgtcatagtacaataaaaatttacaagcatccgcaccagcttcttttaaccttttcaccgaccaaatattcaataaatcaggtaatcttcccggcattttcgtatcatagccggttttttcataagctagcagcaagccacattctttctctcgaagcgctgctgcaggcaggccgtattctggatcaagtaaaatagctgaggcatagggagtcaggtattgagaaaccatctgtttaaattggatgatgtcttctaatgtagcttctttatattggttgatcattttcttcaaagcaccacgctggtcgattgctaacgcgctaataattccagcttcatccgttaatcgcttcaaacgttcccgcttttctatactcatcttcttcatatatcttcacctatttctttagttaatattgtggctatttctgtttttgattttgcttttctcaactgttctgtaacctcttttcgcatcaatgatcgtgcaacgagagacaataatttcaaatgagtcgttcctgcttctgaatctggaataaataacgcaaaaataaaatcaactgactgtctatctaaactgttccattcaattcctttgttcagtgtgacgataatcatactaggttcgttgattgtttgagacttcgcatgagggatagcaaaacctgacattattcctgtagtaccttctttttctctttctagaagtttttgatatacttctttttcgtcatgagcaattcctaagcagaatgtttgctttgctaaaaacttaaatgcttctacttgactatccaatggctgttgtaaaaaaatgttctcttcatgaatgattgtcatgataagtctcctgctcttcctttttcgataactgtacgatttgctgctttattatccatcttcttgtctttatcagttactcttttcttttggattaaccctagtatcactccaccaacgatcgaaccagtaagaatcgctgtaacccattggatttttcccgtcactacaggtaatactaaaaaaccgccatgtggtgctggaacttggacgccaaacaaataagtcaagacagcagcaatcgatgagcctaacatcatcgtgggtaacactcggatcgggtctttcgcagcaaacggaatagctccttccgtaatatgagttgatcctaaaataaaattaaccaaacctgcattacgatcattggtatcaaaatatttaccaaacaataaagtagcaaaaccagtaatcaacggtggtgcaatacaagctgctgacacaccagccataaaagtcgtgtttccttgtgccaaaagagctgttcctgttacatatgccgccttattaaccggtcctcccatatcaaacgcacacatacagccaacaatcatgccaagaacaagtggattcgaatgttcaaatccagctaaaaagctcatcattccttcatttatagccttcattggacctgccagcaaagacatcacgataccaataaatgctacaccaataactggatataagaagattgccttcaagccatctagttgtttaggtaaaattgtcagtagcttttgcaaaaataagataaaataacctgctaagaacccagctaaaatacctcctaaaaatccagtaccgccattcatggccacgattccaccaacaaatccaacgactaaccctggacgtttcgcgatcccttctgcaatataagctgctaaaactggaaccatcattcccattgctgcatcgccaactgcttttaccattgccgctgtagcattgtattgtgcatgatctggatcaaaagaatagattccccaaacggcaaatgaaatagcaatcaatactccgccagctaccacgaaaggcaacatatgagagacaccgttcatcaaatttttatagatgctacgaccaaaattagcaccactcatcgcttctggttctaaagtatcagcagcttcattatctgctaagacagtaccttttcctgccaatgcttcgtcaatcagccgttgtgcatccttgattcctgtactgacagaaacatcaatgactcgttttcccgcaaatctttctgaatggacatctttgtctgcggcaataatgacagcatctgcctgtttgatttcttcagccgttaattcattttcgatcccaatttgtccatgggtctctactttgatcgtgatgccttttttcctagctgcttgttctaatgcctcttgcgcaatgtaggtatgcgcaattcctgtcggacaaccggttgctacaattagttgatattttcccatctttcgaacctctcttccctgattttgatttgtttacttaattcctccacatctaaaaaatctgttaatcctttgcgaaaagcggttgagctgcctgctgctatgcttttacgtaacatttcatcaagcggtcgtcgattcatgtatcctgctaaaaaagcgcctaacatggtatcacctgcacatgctgtattgacaacttttccttttggcgagtttcctcgaaacaccctgtctttcgtaaaaagaattgctcctttctcaccgagggataacaaaacattttctgcacctaactctactagtcgttgtccataaacaaagtaatcttcatctgtaaccatttttcgtccgaaccaagaagaaagttcttcctcgttcggtttcagcaaaaacggtcgatagggtaaacaatccatgacttcttgatcactactatcaataatcaaatgaatccctttttcctgacaaatccgactgatttctattaaaacctttggagacagccctcttggtaaactcccagaaacacaaagataatcttctgcttgtaatgctcttatttgatttaaaaaattatggacagctgtctgcggaatttcaggtccttgattcactaatttgtattcttctcccgtttgattaacttgtgtaaatacattgatacgcgtcataccaagcacttcaataaactctgtttggatttgtttctgctgtaaatagtcttctatatactttcctgtgaacccagcagaaaaacctaatgccgtacttgggaaatctagcatctttaatactagtgacacattcaccccttttccgtttgcctgaatgtcatcctcttttgtgcggtttaccataaaaggatgcatctcctctgtttcaataaatagatcaattgccaaattcatcgtgcatgtgtagatagacataaccaacgacctccttgactctattatgaaatacgcgaaagagaaaatgttttcttaatcgtcccaacacaaagaaaacctttacatttataaactcgtcgtgctattttttaactaacttttggtgaaagaaggaaagaatatggatcacaaattaagtgaaacagaacagtacctctggaactttatcgaacaccatatcctagagatccctaactacaccatcgtgaaactaagtgaacaagcaaatgtctcaacagccaccattgtgcggacaatgaaaaagaaaggctatgaagggtttacttcgtttaagcatcatctaaaagaaagagaaaacaagaacatcaatttttcatttttagataaagtagacaaaggtatccgccgagccattctaaaaaatgaacaagaagtggtacgtacaatcaatatgttggaaatcggaaacattgaggatgcgatacaaagaatcaaatttgctgaccgggtttttgtctttgcccgaggattttcagaaatgattggccaagaaatgctggtaaaacttcaattaacgggaaaaaattgtcaaatgcatactgatccagagattatcaaaagcatcagtcggaaactaactaagaaagacagcgttatttttgtttctttgaacggtgagacaaaagaactcgtcaccgccgcaaagaattgctatgatgcagagattggttcaattctagttacagccaatcattcctctacactcaaagattattgcgagataaatctcgtaggtttcaaatcagaaggttcttatttccctgattatgaagtacggtcacgtttgcctctccagatcatcgcgagaattctgcttgacgcctatgtattgcgtatgggggagaattgaggatatttgatttacaattgataacaattgctagaaaaactgtaaaaaatgctttacgtatctcgctactataatttattagtttcattttccattttagataaaagctatcgtgtactttagcatggctaaaaatactacaaaataaataaacaaaaggaaataataaaaaaatctggaacagaagcttacgcatcctgttccagattagggttgatgaaaattcacatttttcaattcttataagccatttaaatcactttcttattgaacaaagttctaattatcaacttacttgtaaaaactattttttccttaataaatcaaggaacggatttgccttactacagaaaaaagcagtgtcgcgattagcaacaacattgggataatcgtcattattttttcgatttcgttttttcgaaatctttcaacaactcatttatcataacttgttgtttgttatttgtcaagaacttttttgaagtttttttcgatagaatcaagcttcgcaagctgttctttttttaacaactcagttatcttatcatgtcattatcaacatgtcaataacttattttttattattttaagttattggtgttcttttgaacaaataataatatatcaacatcacatacgaaagtcaataagaaaatgcttatttatcaacatttccagcttatatgatcgttaattagttcttctcctttttttgttcgtctttataaccttaaaaaacgaaaaatccttttattttcagtttaacgttcatgtttttgtcctatttatgagaaccaaatctctcaccttctaaaattttccttaacaaagtgctgcttttatctatttctgcttttttttgctagaataatagtaacaatatgactctggaggatttatttatgaaaattttgattgctgacgatgataaagaaatcgttgaattattaagtatctatgttcacaatgaaggctatgaagcagtaaaggcttatgatgggaaagaagcattatctaaaatcagaacaatccctgatattgacttacttattttagatatcatgatgccagagatggacgggatgcaagtagtgaaagagctgcgaaaagaatctcaaatcccaatcattatgctgacagcaaaaactactgatatggataagatcaaaggactggtggctggtgcagatgattatgtaaccaaaccgtttaatccattagaagtaatggctagagtaaagtctttattacggcgtacaaaaatgcagattgccccagatcagcctgatgtattagaagtaaatgcattaatcatcaataaagactctcatgaagttaaaacaatcgatgggaaagaaatccagttaacagctttggaattcggtatcctctacttgcttgctagtcatcctaatcgagtatttagcgcggatgaaatttttgagcgtgtttggaaacaagaaagtattgtctctgctaaaactgtcatggttcatgttagccatttaagagataagatcgaagaagcaactggtggtgaaaaagtcattcaaaccgtttggggagtgggctataaaattgacgcaagatagtaaacgagcaactgaaaaacgccgtcggatcaacttgacttcaaaagaaatcagcgaattgttagcggaaggaatcatcacgatcatccttttacttctattaaatgtttctattttggttgttatcagttcggtaatcaatagttcaccttctttgtcaaatgcgatttgggattcaaagaatatttttgcggaacgattgaacactgatttattttggaacggtcgaaactttattattccctttttctttctattagatattggtgttttgtattggcgtttgattcgaagatatcgccaaatgcaattacgacatatcatcagtgaacttcattacatcgcaaatggaaattatgatcatcgtatcccttttgaacttagtggtgacttaagccgagttgtaacaagtatcaatggattggtagatagcacagtagcagcgattgaagacgaacgtaaaatcgagaaatcaaaagatgaattgatcacaaatgttagtcacgatatccgtacccctcttacttctatcattggatatctaggattgatagaagatggtcagtatcactcagaagaagatcttttaaagtatacacataccgcttatattaaagcaaagcagatgaaatctttagtggacgacttatttgaatacactaaggtacgccagcctgctgtcccagtaaatttttctgcctttgatatgatccagttgatcgaacagttagctgctgattttgagttggaagcttctaaaaaaaatatccaaatacttgtgcagtcaaaagtagattcccttatcatggatggcgatacagaaaaacttgtacgtgtcttcaataatcttttgacgaatgcgttgaaatatggaaaaggagctacgaagatcgtgatcgaagtagaacgtgtcggttcagaagttgttgcaacggtcaaaaataatggagcaatgatcccacaacaggcaatcgataatctattcgaccgtttttatcgtgtagaagaatctcggtcacaagcaactggaggaactgggcttggtttagcaatcgctcaaagtattgtggctttacatggtggctacatttatgcaaaatcagataagcaatggacttctttcatcatgcaccttccaatcaagaaaaatgaaaaattacctattgatgcacaggaagttattgacgaaagctgaaatattcgctattcttattacaattattagaataaatgaaaaacacagaacccagtacactttattctttttcagagagctgatggcaggtgcaaatcagcaaaggataatttggaagttccagttcgtttacgtgccctttcgaaataagaaaggtcggttcaacagccgttatgtgttcaacaagtgcagcttatgctgaacttgggtggtaccgcgaatttcagactgattcgtcccaagaataatgggatggatcagtctttttttattttcaaaaaggaggaaaacatatgttagatgtaaaaatgatgcgacaaaatatcgaagaagtacaagaaaaactaatgactcggggcgttaaaaaagaaacattagttgaattcatggaactagatgaaaaccgccgcaaattactagtcaaaagtgaagaattgaaaaaatatcgaaatgacgtttctgctgagatcgctcaattgaagcgtgcaaaagaagatgcttctgctaaaatcgctgaaatgaaagaagtcggcggcaacatcaaagcattggatactgaaattgctgaagtagatgaaaaattgaaacaaattgccactactttgccaaaccttccccatgattctgtgccagttggatcagatgaagaggacaatgtagaaatccgtcgttggagcgaaccacgtacatttgcttttgagccaaaaccacactgggaaattgcagaaaatcttgatattttagactttgaacgtggcgcaaaagtagccggtagccgttttgtttattataaagggttgggcgctcgattagaacgtgcagtctacaacttcatgcttgatcagcatatttacgaacacggctatactgaaatgattactccttatatcgtcaacagtaaagcgatgtttggtacaggacaatttccaaaattcaaagaagatgttttccaattggagaatactgatttaacattgattccgacagctgaagtcccattgactaactattataatgatgaaattttagatggtgcggatttacctgtttatttcactgcgctaagtcctgcttttcgttctgaagctggaagtgccggtcgggatactcgaggactgatccgtcttcaccaattcaataaagtagaaatggtcaaattctcggatgcagaacattcttacgaagaattggaaaaaatgacagctgatgcagaagatatcttgaaaaaactgcatttgccttatcgtgtaatggccttatcaactggagacatgggcttttctgcagctaaaacttatgatttagaagtatggattcctgcacaagatacttatcgtgaaatcagttcttgttctaactgtgaagatttccaagcacgccgcgccatgattcgttatcgcgataatgatggaaaaatccactatgctcatactttgaatggttcaggacttgcggttggccgtacagtagctgccattttggaaaactaccaaaatgaagatggttctgtcacagttccagaagcgctcgttccttatatgggtaatctgaaagttattaaataaagaggttgtgaaaaagctgtcctgcatcaagtaataagaactgccaaacaaaaatagctcctctgatttttcgttttgttgggcttattaccgcagatgcaagcttttgaacactgtttatcagaggttgtgaaaaagccgcttagtttcgagtattaagaaaaattttgtgaaaatggctttccacatttttgcataaattggacttaataccgagaaactggcttttgaacaccgtttaccaagaggtcgtgagcctgccgttcagctccgagtcacaaggaacaatttcaaaaaacagctcctcatgtttattgaatattgtgacttgtgaccgaggaattggcaggagaacaccgtttaccaagaagtcgtaagcctgccgtttcactccaaaccacaaggagtaatttcaaaaaacagctcttcatattttatgaatattgtacttgtgattcggagttggcaaaggaacattgtttattcaaaaaaagagtggtgacacatgttgtgtcaccactcttttttagtatttttaagattcaactgaatagtttggtgcttctttcgtgatttgtacatcatgagggtgtgattcttttaacccgctgccgctcatttggatgaattgcgcttcatcacgtaattgctgtaaattggctgccccaacataacccattcctgaacgcaaaccgccgatcatttggaaaataatgtctgcaacacttcctttgtaagcaacccgaccttcgattccttctggtactaatttatttgcttcattgacactaccttggaagtaacggtcttttgaacctttctccatcgcgcctaatgaacccatacctcggtatgttttgaatcgacgtccttggaagatttcgaattcgcctggtgattcatctgtccccgccaacatgctgcctagcataactgcatgtccgccggcagctaatgctttgacgatgtcaccagagtacttgattcctccgtctgcaataatcgctttgccatattgacgagcaactgatgctgcatcatagatggctgtgagctgaggtacacctacaccggctaccacacgtgtcgtacaaatcgatcctggtccgataccgacttttacgacatccacccctgcatcatataaagcttttgtcgcttcagccgtcgcaacgttcccagcaatcaatgttgcatctgcaaaagttgaacggatttcttggatttttcggattacacctgcactatgtccatgagctgtatcgatgatgattgcatctacccctgcttctaataaagcattcgcacgctcgaatgtatcgcttgttacaccaacagctgctgctacaagcaatcgaccatgttcatcttttgctgcatttggaaattcgatcactttctcgatatctttgattgtgatcaatccgcttaaacgaccttcgttatcaacgattggtaatttttcgattttatgtttttgcaaaatcttttctgcatcttttagagaggtacctactggggcagtcactaagttgtcttttgtcatcacatcagcaatcggcatgtggtaatctgttacaaaacgcatgtcgcggtttgtaatgatccctaccaattttctgttttcaagtgtttcaacgatcggcacaccactgatacggtatttgctcatcaattcttctgcgtctgctacaagatgctgtggcgttaagaagaacggatcaatgatgacgccactttcagaacgtttgacttttcttacttcatccgcttgctggctgatcgtcatgtttttatggatcacacctaatccgccttgtcttgccatagcgatggccatcttgctgtcggtaacggtatccatacttgcactgatgattggaatattcaacttaatatttttagctaattgtacgctcatatccacttcgtttggtaacacgtgactttctgctggtatcaataagacatcatcaaaagtaaatccttttttcgtgaactttgtttcccagttggacatttttagtaccactcctctaatttagtttatctattaaaataattgattttttcatttaagtcaatgatctacatggaatcaaattagctttctcatagaataccaatataaatcgcttacatctgtgtatatactaaaagagagtgcgacagaagtggttagctgattgaacaccgtttaagaaagaggtcgtgagcctgccgttcagctccgagtcacaaggaacaatttcaaaaaaacagctgctcatgtttgttgaatattgtgacttgtgaccgaggagttggcaggagaacaccgtttaaggaagaggttgtgaaatcagtgttctgattgagtattagagaaacaaacggtaaaatagttcctcatattttgccgttttttgaactaatgccgagggtcagctgattgaacaccgtttagcggagaggttgtgaaaaagctgttctgcatcaagtaataagaacagccaaacaaaaatagctcctcatatttttcgtttggttgggcttattaccgcagatgcaagcttttgaacaccgtttattcgaaaaaaggagctgcgacaagacttttgtcacagccccttactattatttaactatggataaacggaatgaggtcctttactacctctcaatatttagtaaagctactactctgctttctggtttatcttcttggaacggataaacttccaatgatcccatactttttcttcaagtagtaacggacggctaaagcagctgctccgatgatgataactactatcggatctaatactggattgataactggcggcaatagcgttgtcgcagaaaacagcacgacccaaagaagtgtcgttccacctaggataagcaatgttttacccattcctggtttcttgcttcgatctgctcccggatattcatactgatagatgtacttgtacatcatataaaagacccagcccccgattgcagaacctagaacgagtgtagagaagccataagctggcgttgttccacgtgaaaacaatccggtaatcgcgatcatgatacttaatagaccaagcagtagtaatgtattatccaaccacatcaataaaggggtcgatgtattttgtatttctgctggtttattgatgattgcttccgttctttcagagactgtcccgaacaattggcgagctgtttttccgcctttttgttctgcaactaaagtaggcagaatgtcatgaagggcttttactttttcttcttcagacaaattcgctgcttctaaagattttttcaaatcaaaaatgtactgttgatttcttttggttaattttgtttctaaactattgttttcttttacgatttctcgtaattgttctggttccattatctaatagtcctccttagccgttccttttctcaacggtcgtcacaaaagacattctaccatattctacagctagtttgatagcccttttacacattaaagcggaataacattacgtcgccgtcttgtacaacataatcttttccttctaatcgaacacgcccagcttcttttgctgcatgcatgtttccataatgatccaagtcttcaaaagagacagtttccgcacggataaatccgcgttcgaaatctgaatggatgattcctgctgcttgcggcgctttgattccttttttgaatgtccaagcacgtacttcttgttccccagcagtaaagtaagtagctaagcctaacaaatcataagcggcacggatcaactgatccaaacctgattcttcgattcctaaagcttctagaaattctgctttgtcttcttcatctaattctgcgatttcttcttctgcacgagcactgaccacgatcacttctgcattttcttctgccgcaaagttgcgcacttcttgtacataatgattcgcatctgcatctgccacatcatcttctgacacatttgctacgtaaagaatcggttttgtcgtcaataagaatagtgatttaacgattttttgttcttcttctgtgaattcgatcgttcgagcagattttccttcttccagtacaggtttgattttgtccaatacagctagctctgccactgcatctttatctttggttttagcaacttttgctacacgagtatagcgtttgttgatagattccaagtctgctaacactagttccaagttgattgtatcaatatcttctagtggatcgacgcgtccttctacgtgagtgatattatcatcatcaaaacagcggacaacgtgacaaatagcatctacttggcggatatggcttaagaattgattccccaaaccttctcctttactagcgccttttacgatcccagcaatatctgtaaattcaaaagtcgtcggaacagtttttttcggatgtacaagttctgttaagcgttgcaaacgccagtcaggtacttctaccatccctacgttagggtcgatcgtcgcaaagggatagtttgctgcttctgctcctgcttttgtgatcgcattaaacaaagttgattttcctacgttgggcaacccaacaattccagcagtcaatgccataaatttattcactctttctctgcatttttttcaattactttttttaatttcttttcaaaatctcgacgggtcatcatgacgatatgtccgcaattcatacatctgattttgatatctgcgcccattcgaatgacttcccagcggttcgtctgacaagcgtgaggttttttcatttcaacgatatcgtgcaagtcgtacataaaaatagcctcctttttgtttattcttcatcaaattgaatattcaagatatcaagaattcgtgtcaaatctttttgagaaaggtattcgatctcgatcttacctttcccgtttttttcttggatagctacgctcgtaccgaatttatccatcaaacgatcttcgctttctcggatataatagggtttttcctttgctagccttgggatttttttcttttcttttccatcgttttgatttaattcagaaacgatctgttccagttggcggacagttaaattttcagttactgcacgattggctaatttcaagatcaatgatttgtttttcaagcctaacagcgtacgagcttgtcccatagataaacgttgatcttgcaccatttccttaacaagatctggtaaagaaagcaagcgcaaataattggcgatataaggtctgctctttcctaaacgactagccacttctgcttgtgtcagtttcagatttttcatcagcatttcatacgcttctgcttcttctaatggattcagatcttcccgttgcaggttttccaacacggctacttgcatcattgcttcttcgtcaaagtctctgacgatagcagggatcgtttctttttcagctagtttggacgctcgaaaacgtctttctcctgcgatgatctcatatccttttactgcagaacggcgtacgatgattggttggaagacgcctgattgttcaatagaattagctagttcttgcaaagatacttcttcaaatgtcttacgaggctgatacggatttggacgcagctcattcaatggcaactggaccacggtatcatcttttacatccaccgtctctaagttttctaaatcttggaacaatgcatcgattcctcggcctaatcctttacttttcttcacgacttaccacttcctttgccaatgcttggtagacttcagctccccgagaacgtggatcgtagtcgatgatcggttttccatgactaggtgcttctgataaacgaatatttcttgggatgattgtttcatagactttttcgcggaagtatttgcgtacttcttctacgacttcatttcccagatttgttcgtgcatcatacatggtcagcaagacaccttctatttccaattctggattgaagtgcttttggactaaacgaaccgtattcagtaattggcttaatccttccaatgcgtaatattcacactgaacaggtatcaaaatcgaatcacttgctgtaaatgaattgattgtcaaatggccaagagaaggcggacaatcgatcaaaatataatcatactggctgctgacttctgctaaagatccttttaatcttgattctcttgccatcattgatgtcaattcgatctctgctcctgctaattggagagtcgcaggcacaatactcaaattttcatgttcagtgatcaacgtcgcctcatcaattggcaattcattgactagaacgtcatagatgtcttttgtcacatcgggttttctgatcccgacaccactggtagcatttccttgtgcatccatatccactagcaacacttttttgccaaggctggcaagacaagcacctagatttaccgtcgtcgttgttttgccgacgccacctttttggttcgcaacagatattatttgtgccatctcttctcctcctatttgattggctgcttattaggcagaccgggctttcttgggtatttctttggggttattttctttttttgaatgacgataatatgccgttggtcagagacattcggcaaggtaactgcctcttctttgaggaatttaccacctaataaagcaatcgcttgttttgcttctgtcagttcctcttcactttttgctgctttcaatgcataaaaatagccttcttgtttagccaagggcaaacacaattctgctaacacattcaaacgagcaactgcacgagcagtgacaaggtcaaatgatgcacgaaattgaggattttgtccaaatgtttctgcccggtcatgatataaggaagcatcaattcctaataatcgagttatttcagacaggaaggttattcttttattcagagaatcaacaatcgttatctgcaattcgggaaaggcaatttttaaaggtacgctaggaaatcctgctcctgaaccgacatcgcataaagataaaggttgcgtaaagtctacttcaaatgctaacgtaagcgaatcgtaaaaatgcttcaggtatacgtctttttcatccgtaatggctgtaagattcattttttcgttccattcgactaatgtccgataatagatagcaaattgttccatttgatgatcggtaagctctatccctttttctgccaaagattggcgaaattcttctggtatcataattattcctttcattgtgaaacagcaattgtttcacagattctctccctactttaacgcaaaattccaagacatgcaatccttccatatggattcttaaaaatttgaaaagtaagaaacgccgatagattttttctttctattatggcactcataaaatacacatagaagagagaactagctttgagcaatttctgcaaaaactggttctctcttctatttattattacgtattacgctggttcactgactttcgcaatcttcccttgttcgatatagaccattaagatgcttagatctgcaggatttactccgctgatccggctagcttgggcaattgtttctggttggattttctgcaatttttgttttgcttctgttgctaatccgttgattgctgcgtagtcgatgttttctggaatctttttcgcttccatgcgttttaatttttctactttttccatggcttttttgatgtagccttcatatttgatttggatttctacttgttcgatttcttttcgtgttaattcttcattctctggaataaaccgtagaagatctgcataagtaatctcagggcgtcttaaaaagtcgcttgctagtacgccatcttttagaggtgccgcattaatcgtcgctaaaaaggcttgaacttcttctgttggtttgatccgtacattcatcaaacgtttgatttcttgttcaactgcttcttttttcttcaaataagccttgtattggtcctcttttactaagcccacacggtgacccatttctgtcaatcgcaaatctgcattatcatgacgtaaaagcagacggtattcagcacgtgaagtcagcaaacggtaaggctcgttcgttccttttgtcaccaaatcatcgatcatgacaccgatgtaaccatcacttcgtttgatcactaaaggctcttttccttgaactttcaaagctgcattgataccagcaatcagtccttgtccagccgcttcttcatacccgcttgtaccatttgtttgtccagctgtataaagattttcaacgactttagtttctaatgtcggacggagttggtgtggttctactacgtcatattcgatagcatatcctgtacgcatcatttctactttttccaaaccggcgatggaatgaagcatgtcgacttggacatcttctggtaaagaagtagataacccttgaacatagacttcttctgtgttcaagccttctggttctaaaaatagttggtgacgtggtttgtctgcaaaacgcacaatcttatcttcgatggatggacaatagcgagcgcctaccccttcaacgatccctgtaaacattggggcacgatgtaagttgtctcgaatgatttggtgagtcgtctcacctgtataggttagccagcaagattcctgatctagtttataggcactatctggtgtgctgaagctaaaatgattcggctctttgtcaccaggttgttcttctgtaacagaataatcgatcgtacttgattttactcgaggcggtgttcctgttttgaaccgttcgatagcaaagccaagttcttttagatgattcgctagtccaatagaaggttgagagttattcggacctgatgaatattttaattcaccgataatgatttctccgcgaagtgctgttccggctgtaataacaactgcttttgcccgatagctcgctcctgtggaagtcactacaccatgacaaacaccatcttcgacgatcagttcttcgacgattccttgtcttaacgtcaaatttggttctttttcgattgtatgtttcatttctgttgaataagcatgtttgtctgcttgtgctcgcaatgctcggacagctggaccttttcctgtgttcaacatacgcatttggatataggttttatcgatattcttacccatttctccacctagcgcatcgatttctcgaacaacaacgcctttagctggtccgcctacagaaggattacatggcatgaatgctaccatatccaaatttattgtcagtaataacgtttttgagcccatacgtgcagcagcaagtgcagcttctgaaccggcatgtcctgcgccgacaacgatcacgtcatacgcatctgcttcataatgtttcaatcgtttgttcctccttttattttcctaaacaaaattgactgaataattgagtgatcaattcatcttgtacactatcgccaaccacttctcctagatagtcccagcaacgcgtcatatcgatttgaacgagatccacaggcattcctgcatcaatacctgcaatgacttcttcaagtgacagggaagctttttctaacaatgcgatatggcgggtattggaaacataagtagcgtctctttctcctgtttctccgctgaagaataactcagaaatagctgattccaaacgatctagtccgtcgtttttagctacggaaattgaaaaaactggttcattttcgttccatttgttcaatttttcttgttccaactgtgctggcaaatctgttttatttagaagaatgatccgtttcaatccacttgtcgcttccagtaattgttcatcttctgctgtcagtggttcgctttggtttagaacaagtaagatcaagtctgcttctgctaatgctttacggcttctttcgaccccaatacgttccaccacatcttctgtttcccgaattccagctgtatcgattagcttgagcggtacgcctcgaacattgacatactcttcgattacatctcgagtcgttcctgcaatgtccgtaacgatggctttttcttctcttaacaaatggtttaacaagcttgatttgccgacatttggccgaccgatgatcgccgtacttaacccttcccgcagaacctttccttgcttggacgtagcaagtagtgcttggattctttgttggatcatctgtgctttttcaagcaataacttcgtagtcaattcttcgacgtcgtcatattcgggataatcaatatttacttctacttgagctaatgtctctaaaatctcttgtctcaatgagcggatcaaagcagacagattgccgtctaactgattaagggctaaccccattgctttgtctgtttttgcccgaatcaaatccatcacagcttctgcctgtgaaaggtcaacacgaccattcaagaatgcccgttttgtgaattcgcctggctcagctaatcttgccccttctcttaacaataactgcaaaatttgattgactacgacgatcccgccgtgacaattgatttctactacatcttcccgcgtaaatgtctttggtgctctcatcacagagaccatgacttcatcgactagctgatcgctcttaggatcaacgatatgtccataatgaatcgtatggcttggtacttcagatagtcgtttattcccagaatgataaactttatctgctagttgcacagcttgatcgccacttaaacgaacgatactgattgccccttctccaggcggggtagaaattgccgcaatcgtatcaaattctaaagtaatttcagccattttttcacttcctttttcattttgcgcacaaaaaaagtgcccactccaccctttatgcataataaacggtgaacttcgcactttgactgcttgttcttgattaaattctggtcataggttatcacacttgctataaggaatcaagtgtttaaaacaagttatatgaagttgtacctcacctgattccattaccttacatttaattgactttggatgtctctttgtgttctttggtttattcgaagagaaaatgctgtataaacaaggctttatctttcttaaaaaaaacggtacactaaatggtagcgctatctaaactatacacttttgaaaggagaaaaggagtgagccagttcaactctgatgcattgaaagaagaaagtgattctcggatcaacgatgttgttttatctacaggaaatatcaatcaaaaatatatcgtccgcgatatcgtttttgttgtggaatgcttagaagctgatttgtttgacccagcttttcccaaagaggatcttttcttgacaacgaagaggaaattaaagatgaaggttcttgaatatggtgcgaatgcggtgatcaactgtcattttgagtatcagcaaagaaatcgggatggaaagtattttctggaactttttgcttatggaacagtgatccaatttatccaaacgacgattggttaaatgaaacaggtacaaaaaaagcggagcaaaactgaaaacagtttcgttccgcttttttctatcaaagttagtgactacttcatcgtatactctgataagaatgatttctagtaaaatatacttggtttgaaaaactttgtcaacgtgatttattcaaaaagtaatggaatcaataatattttttagcaggttcaactactaagtaacgataaggttcctcaccttccgaatgtgtttttacatgttcatctttacttaatgcagcatggatttgtttacgttcaaaggcaggcattggttctaagaaaacaggctgtcctgtccgttttactttttcagccgtgcgatcagctaaacgctgaatgatctcttggcgcttttcacggtaattgcctacattgaccactacagatagcttatttcttgctaaacgatggatgaagacttgtgccagatattgcaatgcattcagcgtttttccatgtttcccaatcagtaacccttgcttttgtgtttctaaatggaaaacgaccatattattggattctctttccattttgacaagagctggagcatcaagctgttttgaaatttcagtaagatagactgccaattccgttaaagctgcttcatcacctagctcacttacttcttctgttttttcttcaagaatcgtttcgttgactacctcgatctcagctgttggttcttcttctaaaatctcttctaccgtctgttctactgtttcagaaattttttcactgatacttggctggatcgaaagccgtgcattttttcggcccattcctaggaaacctttttttccttcttccagtatttcgatttcaacttggtctttggccaaacccaaatcagctagacctagttgaacagcttcatctattgttgcagcttcataaatcggcattagcattccctcccctattatttccgttttttcttaggattcattgctttcttcaatgcacgttctctttcgcggattttacgtgcttcttcttcccgttcttttcgaattttgaaaggattgttgatcagcagcgtttgtacaacttggaaggcattggaaaccacccagtataatgaaagaccgctggctaaattgacacccatcactaaaatcattacaggcatcacgaaattcatgatcttcattgatgcattcgattcaatctgactcatgctagataaatacgtacttgcaaaagtaaagattgctgctagaatcggcaagataaatgttggatccgcgttccctaagttcaaccataagaaatggccttgtttcaactcaggtacacgggaaatagattgccataacgccatcaagattggcatttgtaccaataaaggaagacaaccagcatatggattgactccattttccgcatataaacgctgttgctcttctcttaatttactttgtgtttctgggtctcttgaactatattgttgctgcagtgcttttaatttcggttgtaattcttgtgtcttgcgcatgctctttgtttggaaatgcatcagcggcaacaagatcacacggatgatcaatgtaaataaaatgatccctatccctgcattaccaaatgacaacgccttgatcgcctcagcaaagtaataaacaatataacgatcccaaattcctgtactttgtgcgctgacttccccagttccgcaaccggataagacgatgaccaaactaacgataccggccatcaaaagtaaacgtttgtatttcttcacttactcttttcctctctgtcgattatttttgcaagttttaagacgtggactaaattggagcgaacctcatcataagtcagccccttcacacttggtctagcaatcacaataaaatccaactccggatcaatctcttcttttatagaataaactgctgctcggatttttcgtttgacttcattgcggcttaccgcgttgccgaccttttttcctacagataaaccaactcgaaaatgaggctgtcccggttttttcaaacggtaaacgacgaatttgcggttagcaaaagaatctcccgtatgaaacacggcttgaaactctcgttctttttttactcgatacgcttttctcattagttttctttccttttctatctctcacttacgctcataatcataccataattacgattgtcctttcatcatttccctaaaaaagagtataaaaaaaaccactgaaaccccagtggcctaagctgaaagaacttttcttcctttacgacgacggctagctaacacacgacgtccatttttagtactcatacgtttacggaatccgtgaactttttgacgtttacgtttatttggttggtatgttcttttcatatattccacctccaaaatgttcttatctattttataaacacagacatactttgatagtataacgacaaagtagtgattttgtcaatataaaatagaagatcgattgtcaaaacttatccacaagattatttttttctatgggaatcccatgtggaaaaagttatgcacaggaattatccacaaataataacgaggcacttttacacagaaaacacacgtgtaaaaaaagtaatccacaaccaggcatttttctgtgcattttgtccctaaactattgataaatatatatttgttatccacaggtataggaggaaatctagtgatttttacgagttgtccacctgtgcattagtggtgtggaaaactttttttgacagctgtgtttttctcttttttttatttgtcgattatgtggataattgtaattaaaaaatttttttcttcggtttctgtggaaaactattgaaaaaaatgctaaattagtactagttattcactttttaatgaaggaggaggccttatatggtatccctcgatgctttatggaatgaattaaaagcaacataccaaaaggatttatcgcctgctagctataatacatggattgaaacagcgaaccctcgaactcttgatcaaaaccagctcgttgttgaggttcctagcaagattcataaagaatattgggaaaaaaacctggcaacaaaaatcgttgaagtcggttatatgctatcaggaaatgagattatccctcgctttattactggcgaagaagcagagcaagaagaagttgtagaagagaaaaatccaaaagttgcggcacctagtccgctaaaaaaagccatgctgaatcctaaatatacctttgatacgtttgtcattggtaaaggaaaccagatggctcatgcagcagcgctcgttgtagcagaagatccaggttctatttataacccgctcttcttttatggaggcgtaggacttggcaagactcacttgatgcatgcaatcggtcatcaaatgctgcaaagtcagcctaatgccaaagtaaaatatgtaagtagtgaaacttttgctaatgatttcatcaattcgatccaaaacaaaacagcagaagaattccgtcaagaatatcgaaatgttgatttactattagtagatgatattcaatttttcgcagaaaaagaagctacgcaagaggagtttttccatactttcaatgccttgtacaatgaaggtaaacaaatcgttctaaccagtgatcggttgccaaacgagattccgaaattacaagaacgccttgtttctcgctttgcatgggggctgtctgttgatattacgccaccggaccttgaaacaagaacagcgattttgcgtaaaaaagcagcagctgaacgtctagagatcccagatgacacgctgagctatatcgcaggtcaaattgattctaatattcgtgaattagaaggggcacttgttcgagtacaggcttttgctgcaatgaatagtgaagatatttcgactagtctagctgcagatgcgctgaaaacgttgaaatcaggaaaaggacatcctcaattgtcgattttgcagatccaagaagaagtggcaaagtattatcacatccaattgaaagatctcaaagggaagaaacgcgtcaaatctattgttgttcctagacaaatcgctatgtacttggcacgtgagctcacagataattcattaccgaaaattggtgctgaattcggcggcaaggatcatacaacggttatccatgcccatgagaaaatccagcagctgatggattctagtgtcagtatgcaaaatgaagtatcagaaatcaaaaactttttactaaattaatttgtcgattctaccaactgaaaatagcatgtggataaaagaaaaaaacaagcaaaagttatgcacactttttccacagctgttttttcgtttctctcttgcgttttttgagttttccacagaatcaacatgccctattacttttattattctttttaactaataataaataaacaaacattcaaaggagatacatcatgaaagttactttaaaccgagctagctttatgcaggaattgcaaactgttcaacgagctatttcaagcaaaaccactatccctattttgacaggtgtaaaaatcacactgacacaagaaggtttgactttgacggggagcaacgctgatatatcaattgaaacttttttgtctgttgaaaacgaaaaagcaaatatgcaaatcgaatctaccggatcaattgttttacaagctcgtttctttagcgaaatcattcgaagacttcctgaagaaacatttactttagaagtattagaaaataaacaagtagcgatcacttctggaaaagcgaattttatcgtgaatggattagatgcagataattatcctcatcttcctgttgtagaaagccacaaccagatgaaattaccagtacacgtattgactaaactaatcaacgaaacagtttttgctgtgtcgcagcatgagagtcgtccgatcttgacgggtgtgcattttattttatctgatcattctttattagctgtagctactgactctcaccgtctaagtcaacgcgtgatcccagtagaacaaacggctgatcattttgatattgttattcctgggaaaagtttgatcgaattgtctcgctcactgacaaatgaagaagaaatcgtcgaaatcagcattatggaaaaccaagtcttgttcaaaacggaaacaatgtatttctattcccgcttgttagaaggaaactatcctgataccaatcgtttgatcccatcaagctttaatacagaggtcgaattttctgttcctagttttctagcggcaatcgaacgtgcttctttactttctcatgaaggccgcaacaatatcgttcgtttatccatccgtccagatgcggttgttttatacggaaattctccagaaatcgggaaagtagaagaaagcttgagctatacagcaagcagtggcgatccattggagatttctttcaacccggattatatgaaagcagcgttgcgtgcatttggagatatgagtatcaaggtaaaatttatttccgctattcgaccattcacgttggaaccaacggaagatggcgttcaatttatccaattgatcactcctgtacgtacaaattaacaaagattttcaaagatattgaaaatttaattgaaaagaattagaaaaaataaaatttaaacagaaggccctaaaatctcttttaaggctttctgtttatttttgtttaaatcaccttttttagattaaatcgtcttatatggaaaaatatatggataaatttgttttattgcggaaaaaaaggtataatagagtatacttttaataatgaaaatgagggatggacattgaaacaacaagtcattctaaatacggaattcatgacgttgggtcaaatgctgaaagaagccaccgttatcggtagtggcggacaagcaaaatggtatttggcagaaaacactgtgttagtcgatggcgagccggaaaatcgtcgtggacgcaagctttatcccggtatgatggttgaagttccagaagtaggaactttttttatggtaaaaaaaggaaacgacgataatgaggctgaataagctgtatttaaaaaattatcgaaattacgaagagctgaacatcgaattttccaagaatctggtcatttttttaggtgaaaatgcgcagggaaaaacgaatcttttggaaagtatctatgtattggctatgacgcgaagccatcggacaagtagtgagcaggaattgattggttggaatgacgatcaggcaatgatccaaggagagatcacaaaaggttcatccactctcccattagaaatcttattatctaaaaaaggccgaaaaaccaagatcaaccatatcgaacaaaaaaagttaagtacttacgtgggacaaatgaatgtcattttatttgcaccagaggatctttcgttagtaaaaggcagcccgcagatcaggcggaaatttttagatatggaattaggtcagatcaatccaatctatctttatgatcttgtccaataccaagcgattttgaagcaaagaaaccagtacttgaagcaactgaatgaaaaaaaacaaactgatttgctttatttggatattttgtccgaacaactagcagcgtttggcagcaaagtattgaaagcaagagcacagtttatcaagcgattggagttttgggctaattctttacatcagcaaatcacacatcacaaagagcagctggaaatcgagtatctcaccgcagtcgattctttagaaacacatacgcaagaacaaatccaagaacaatttctcgcacttttgaatcaaaataaaaagaaagacctttttcggggaacgacgacagttggtcctcatcgtgacgatctttccttttttattaatcagaaaaacgtgcagacttatggatcgcaaggacagcaaagaacgactgctctaagtgtcaaattagcagaaatcgatttgatcaaagaagagacaggggaatacccgatcctattattagatgatgtgatgagcgagctggatgataatcgtcagctccatctgctggaaacaatcgaaggaaaagttcaaacgttcttaacaacgacgacacttgaccatgtaaaaaataaaatgactgttgaacctgagattttttatgttcgacaagggaaactaaaaggagaagaaactgaatgacagaagaaagaagtttagtagaacgcgctaaagaatatgatgccagtcagattcaagtacttgaaggacttgaagccgttcgtaaacgacctggtatgtatatcggttcgactagttctgaaggtctgcatcaccttgtttgggaaatcgtcgataattcgatcgatgaagtattagcaggttttgcaacaaaaatccatgtgattatagaaaaagacaacagtatcactgttattgacgatggacgggggataccagtggatatccaagcaaaaaccggacgtcctgcagttgaaacggtctttactgttttacatgctggaggaaaattcggcggtggcgggtacaaagtttccggtggtcttcatggagtgggatcttccgtcgtaaacgcactttctacgcaacttgatgtcaaagtatacaaagaaggaaatgtgtactatcaagagtatcgtcgtggagctgtagtggacgacttaaagatcattgaacaaacggatcgccatggaacaacggttcactttacgccagatcctgaaatttttacagagacaactgagtttgatttttcaaaattggctacccgaatccgtgaactagctttcttgaaccgcgggatgcgtatttcgattgaggacaaaagagaagaagaaccagtcatcaatgaataccattacgatggcgggatcaaaagttatgtcgaatacttgaatgcaaacaaaaccgtgattttcccagaacctgtatatttggaaggtgagcagcaagatatcgcagttgaagtctctatgcaatatacagacggctaccattccaatatcatgagttttgccaacaatatccatacgtatgaaggcggaacacatgaatcaggattcaagactgcattaactcgggtgatcaatgattatgcccgaaaacaaaagctgatgaaagaaaatgatgacaacttgactggtgaagacgtgcgagaaggattgacagctgttatttctatcaagcatcctgaccctcaattcgaaggacaaacaaaaacaaaattgggcaattccgaagtacggacagtcactgatcggttatttagcgagcatttcatgaaattcttgctagaaaatccaagtgtgggccgtcaaatcgttgaaaaaggattattagcttccagagctcgtctagcagcgaaacgtgcgcgtgaagtaacgagacgtaaaggtgctttagagatcagtaatctgccaggaaaattagcagactgctctagcaacgatcctgaaaaatgcgaattgttcatcgtcgaaggagattcggccggcggatcagctaagcaaggtcgtaatcgagaatttcaagccatcttgcctattcgtgggaaaatcttgaatgttgaaaaagcaagcatggacaagatcttggcaaatgaagagatccggtctttatttactgctatgggtacagggtttggagaagatttcgatgtatcgaaagctcgttatcataaattagtgatcatgactgatgccgatgtcgacggtgcacatatccgtacattgttgctgactcttttttaccgttacatgcgtccaattgttgaagctggttatgtctatattgctcagccacctttatacggggtaaaacaagggaagaatatcacgtatgtacaaccaggaaagaatgcagaagaagagttgaaacaagtcgttgcttcacttcctgcctcaccaaaaccaagtgttcagcggtataaaggacttggagaaatggatgatcatcaactatgggaaacaactatggacccaagtaatcgaatgatggcccgcgtcagcgtggatgatgctatcgcggcagaccagatatttgaaatgttgatgggggatcgagtagaacctcgtcgtgcattcatcgaggaaaatgcacattacgtgaagaacttagatatttaatcatgaaggaggaaaaagaatgagtgaagaaatcagagaaaacatccatgatgtcaatctaaccagcgaaatgaaagactccttcatcgattatgcgatgagtgttattgtcgcacgtgcactgcctgatgtcagagatggtctgaaacccgttcatcgccgtattttatacggcatgaacgaattaggtgtgacaccggataaagcccataaaaaatctgccagaatcgtcggagatgtcatgggtaaataccatcctcatggggatagtgcaatctatgagtcaatggtacggatggcgcagccatttagctaccgttatatgctagtggatggtcatggaaactttggttctgttgacggtgacggtgccgctgctatgcgttataccgaagcacggatgagcaaaatcgctacagaaatgctgcgtgatatcaataagaatactgtggatttccaaagcaactatgatgacacagaaaaagaacccgttgtattacctgctcgcttccctaatcttttggtgaacggaacgacggggatcgccgtgggtatggcaacgaatatcccacctcataatttgtctgaggtagtagcggctatcgatttgctgatggataatcctgatgtgacgaccaatgaattgatggaagtattacctggaccagattttccaacaggtggtttggtcatgggaaaatcaggaatccgaagagcgtatgaaacaggtaaaggttctattaccgtacgtgcaaaagttgagatcactgagatgccaaatggcaaagaacggatcctcgtgacggaattaccttatatggtcaataaagcaaaattgattgaacggatttctgagttgcacagagacaagcgtatcgaaggaattacggatttgcgggatgaatcttcccgtgaaggcatgcgaattgtcattgacgttcgtcgtgacgccagcgcatcagttattttgaataacttatacaaattgacatccttgcagaattcattcggattcaatatgttggcaatcgaaaaaggcgtgccgaaagttttaagtttgaaacaaatccttgaaaattatatcgaacatcaacgcgaagtcatcacacgacggacggtctttgaaaaagaaaaagcagaagcaagagcacacatcttagaaggtttgcgtattgctttggatcatatcgatgaaatcattgcgattatccgcgggtctaaatcagatgacgaagcaaaagcaacaatgatcgaacggttcgatttatccgatcgccaatcacaagctatcttagatatgcgtttgcgtcgattgaccggtttggaacgggaaaaaatcgaaaatgaatatcaagaactattgaaactgattgaagatttgactgacattctggcaagacccgaacgtgtcacagaaatcatcaagaatgaattagcagacttgaatcaacgatttggtgataaacgacgcacagaattactagtcggtgaggtcttaagtctagaagatgaagatttgattgaagaagaagaaatcgttattacattgacaaacaatggttatatcaaacgtttggcaaataatgaattcagagctcaacgaagaggcgggcgtggtgtccaaggaatgggtatccacaatgacgacttcgtcaagaatctagtttcttgttctacccatgatacattgttattctttacgaataacggaaaagtgtatcgggcaaaaggatacgaaattccagaatacgggcgtacagccaaaggaatcccaatcatcaatttgctgggtatcgactcgagtgaaagcatccaagcaattattgcggtgacgggagaagcagaagaaggccactatcttttctttacgacgcgtcaaggtacagttaaacgtacgtctgtcactgctttcgctaacattcgaagcaatggcctgattgcaattggtttgaaagaagatgacgaattagtcaatgttctattgacagacggacagtcaaatatcatcattggcacacataacggctactctgtgaccttcaaagaagaagcagtccgcgatatgggacgtacagcttccggcgtcagagggatacgtctgcgtgaggaagattacgtcgttggggcagccttgatgaaggaagaccaagaagtactggtgattacagaaaaaggttacggaaaacggaccaaagtatcggaatatccagtgaaaggccgcggaggtaaagggatcaaaacggcgaatatcactgaaaaaaatggtccactagccggattgaccactgtttctggaaatgaagacatcatgctgattacagataaaggtgtgattatccgtttcaacgtatcgactgtttctcaaactggacgttcaacattgggtgtacgtttgatgaagatggaagctgatacgaaagtcgtcacaatggcagcagtcgagccagaagcggtagaacaaacagttgaagagcaagcaacagaagaataaccatcaagactaagtgtgtaagctagcaagaatgaccgattaaaaaatctggttattcctgctagcttttttgattaattgaatttctcttaaaatatttgaaactgtttattctgtattgcttttgaccaaaatagagtgtataatcaaagcttgtgagtagtctaattaattagataactctccttgctcttaggaacctaagagccgaaagtccacagggaggtgaatatcaatggaaaacacgaaatatgaaatcatgtacattattcgtccaaacattgatgaagaagcaaaaactgctttaatcgaacgtttcgatgcaatcttgaaagataacggagcagaagttatcgaatcaaaagattgggaaaaacgccgtttcgcttatgaaatgaacggttaccgtgaaggtatctatcacatcgttaaagtatcttctccatcatcagcaaatgctgtcagtgaatttgaccgtcttgctaaaatcaacgacgatatcattcgtcacatgattgttaaagaagaagcttaattgttgtttcatgtgaaacaatagaaaaacgatgagaggagatgactattttgattaataatgttgtattagttggacgtctgacgaaagatccagatttgcgttacacagcaagtggtacggcagtcgcaacatttactttggctgtgaatcgtaattttacaaaccaaagcggcaatcgcgaggctgattttatcaattgtgtgatttggcgcaaatcagcagaaactttagcaaactatgctcgtaaaggaacacttttaggtgttactggacgtatccaaactcgttcttatgataatcagcaaggacaacgtgtatacgtaacagaagtagtagctgacaacttccaattgctggaaagtcgttctgcatctgaaaatcgccaacaaagcggcggattccaaagttctggtcaatcagctggcggatttggcggaaacaataactctaatcaaacatctcaatcatccaacggtatgcctgatttcgaccgtgatacttctgacccattcggctcaagttcaacgatcgacatttcagatgatgatttaccattctaaacgaatttgataggagggaaatagaatggcacaacaaagaagaggcggacgtaaacgtcgtaaagtagactacattgctgctaaccatattgaatatatcgattataaagatatcgaattactaaaaagatttatttcagaacgcggtaaaatcttgccacgtcgtgtaactggtacaggcgctaaaaaccaacgtaaaattactgttgcaatcaaacgcgcacgtatcatgggcttgctacctttcgttagcgaagactaataaatccgaggaattgaatgactgatccttttgatcagctattcaattcttttttttctgtaaaaataaccgatattcgtttagtcgcttgaatgacgaaagttatggtaaaatcaagttagtcatatatgggaggaaaattatggaaaataaaaacaatcatttatccccaaaacctctcttccttatcctgtttatactaatcgaagtattggtagtcttaattttaccatttcgttttgttagcgcttcggtcattcttttgatgaatttatggggcgttcgctattggttgaaaatgaaacgctggcttactttaaataaacgtgaaaaaatccagcaggcttcgaccgtagccgaaacaaatctggcttatgtctcagaagtcatgcctgtaggagtgattgcttatcagccatcaagccaaaaaatcgaatggctcaatcctttagcattgaaagtcaaagatcaaagtggattaacagaggaagaattgttagatactttttttactgcaaaagaaaaaaagaaaaaccaagtctatctagcagataaaacatttcagtttgatatggatacagtaaagggtgtcgtttattttaatgatatcacccaaaaccagttattgaaacttcatcaggcgaacagtcagccagtgatcggtattttatctattgataactatgcagatgctattgataaattggatgacaaagagatttcttatttgaactctttcgtcactacacttgtttctgactggatgaatgaataccatgtctttttcaaaagaatcaacgcagaacggtttttcttcgtcgcgcagatgatcgatctgaaaaagatgatggataaaaaatttgatttgttggatcgctttcgagcagaagctgaaaaacagagctcgcctatcaccttgagtatggggattgcttatggcgcaagatccctcgatgaaatcggtggagaagctcagaacaatttagatgttgctctagtccgcggaggcgaccaagttgtcgtgaaagaggtaaaagaaggagcgaaacctgtttattatggcggtaaatcagctaagaatgtcaaacgcacgcgtgtccgttctcgagcgatgagtactgctttgcgccggatttttgatgaaacaggcgatgtgttcatcatgggacacaaatttccggatatggatgctttaggctctgcttttggtgtcagttgtcttgcacgcttcaaccagaaaaaggcttatatcgttatcaacgagaacgagatcattccagatgtagaacgttgtctcgaagaaatccataaacatccagaattagaaatgcaattgatctctccagaacgcgccatagagctgaaaaaagatgaagacctcctcgtgatggtggattatcataaaccttctctatcgatctctcagagcctatatgagcaatttgataagatcgtgatcattgatcatcaccgccggggggaagagtttccaagcaagcctttgctgacttatatcgaatcttcagcctcttccgcttcagagctagtttctgaactgatccaataccaaagcagcaaaacgaatcgcttagatcgttttgaggccacactattacttgcagggatggttgtagatacgaatagtttcaatgttcgtacaactgcacgaacttttgatgttgccagctatttaaggtcttgtggagcagacgcatccttagtacaatatttattgagctcggacttagcgacatacttggaaatcagtcatttgattgctggaagcgagtatgtgacttctgatattgttgtggcggcaggaacagatgaaaaagagtataatagtgtcatagcggcaaaaacagcagatacactgctttcgatgatcaatatcaacgcagctttcgtcattacgaagcggacagacggattgattgggatcagtgcccgaagtaccggtacgatcaatgtccaaatcatcatggaatccttaggtggtggaggacacttcacaaatgcagctactcaactggagaatacgacagttgaagaaacaaaacagaagctttttgctgcaatcaaagaaaatatgaatcaaatatatgataaggagtaatccaaatgaaagtaatttttttacaagacgtaaaaggaaaaggtaaaaaaggggacatcaaagaagttccagcaggttatgcacaaaattatctaatcaaaaataacttggcaaaagaagcaacgaaaagtagtatcagtcagttagctggacagaagaaagcccaagaaaaacacgaagctgaaatcttggaagaagctaaaaaattaaaagacttcttggaaaaagaagatacggtagtcgagttaaaagcaaaagcaggggaagacagccgtttgtttggatcgattccttcaaaacaaattgctgaagggctaaacaaacaatacaaaatcaaattagataaacgaaaaatcgaactagaaaacccaatccgttcactaggctacacaaacgtacctgtgaagttgcatcatgaggtgacggctacgatcaaagttcatgtcgtacaagaataacaagtcttgatagtgatgttcagctggtaagaagaaccagaaggagaaaagacaaaccgaaatttatctgagaaaagcagctgcagcaacaaaagcacaagctgcatatcgatttcagattgatttcggtttcttttttgagaacagtaaaatagcatgaagaaaacgagtataataaaagagagctatttttttatgatactttcgatgcgaatgatgacttttccatcattttcttgtaaaatgaagcaattgaagacaaggagcgatacgtatgaatgaagtgtggcaggatcgaatcccaccgcaaaatattgaagctgaacaagcggttctaggctctgtttttcttgatgcagaaacgatcattgatgccatggagtacatagagccaaaagacttttatcgtcgcggccatcaaattatttttgagacaatgatcgagttgaacgatcgtaatgaagcgattgacgttgttactgttaaagaccggctagaacaagcaaatttgttagaagatgccggtggtttaagttacctatcagatttggctttagcagttccgacagcagcaaatatcgtctactatgcgaaaatcgttgaagaaaaatcattattgcgtacattgattcagacagcaacagggatcgttacaaaaggattcgagcaaggagaagaagttcagacgatcttagatgatgcagaacgcagtatcttggaggtttcggaaaaaagaaatcgaagcggctttttatccattgctgaagtactgaactcaacgattgaaaatatcgatcgactagctcaaaacaatgaagaaatcacaggcctaccaactggctatcaaggtctggacaaaatgacagcaggtttccagcccgaagaactaatcattctggctgcccgtccagcggtaggtaaaacagcgttcgcattgaatattgctcaaaatgtaggaaccaaaacagatcgttctgttgcgatattcagtctggaaatgggggcggaatctcttgtaaatcggatgctttgtgcagaaggttcgattgaagctagccatttgcgtacaggtcagctttcggaagaagaatggtcgaatctgatcgttgcgatgggaagtctttctcgagcaaatatttttatcgatgatacaccagggatcaagatctctgaaatccgcgcgaaatgtcggaaactagcgcaagaaaaaggcaacctaggcttgatattgatcgattatttgcagttgattgaagggaacggtaaagaaaaccgtcaacaagaagtatcagatatctcccgccaactgaaaaaactggcaaaagaactgaaagtacctgtcattgctctttcgcagttgtctcgtggagtagaacagcgacaagacaaacgtccagtactaagtgatattcgtgaatccggatcaatcgaacaagatgcggacatcgtagccttcttgtatcgggatgattattatgaaagagaaggcggagatgacgatgatggaaatgagccaaaaaatgacaacgtcatcgaagtcatcatcgagaagaaccgaagcggtgcgcgaggaacagttgaactgctgtttatcaaagaatacaataaattttcgtcgctttcgccaagagaagaattttaaagaataggttgtgaaagcagcgttcagccttgcgcaatgaccaagggcactcgtataagatgcgacgagtaactgcaagagtgactagagcacttaattaaaacagatctccaaagggattgtgacaaaagtcttgtcacaatccctttttccgaataaacggtgttctcctgccaactcctcggtcacaagtcacaatatcatcaaacatgagaagctgttttttgaaattgctccttgtgactcggagtgaaacggcaggctcacgacctctttcttaaatggtgttcaaaagcttgcatctgcggtaataagcccaaccaaacgaaaaataggaggagctatttttgtttggctgttcttatgacttgatgcagggcagctttttcaacaatttgagtgtaccataaatgcctttttatttttctaacttaattttacaattcgcgagtaaaaaagaatggagaacgacttcaaaagtcgttctccattcctatacatcgtatctgttatgtggatgcttacgctttgttagctgaaccaaaccagtcgatatgagctttcgcatcttcaacgattgctgctttacctggagctaataatttacgagggtcgaatcctttaccttctttatctttaccagcttcgatatatttacgagtagctgcagcaaatgataattggaattcagtgttaacatttacttttgagatacccattgagatagctttttcgatttgatcttgaggaatacctgatccgccatgtaatactaaaggcatgtctggacctacagcatcagcaattgcttgtaagtggtcaaatgctaatcctttccagttttctggatattgaccgtggatgttaccgataccgcaagctaagtagtcgatacctgtagcaaccatttgtttgcattcttcgatgtcagctaattcgccgttaccgatgattccgtcttcttctccgccgattgaaccaacttcacattcaactgagataccttttgcgtgtgctttttcaacaacgtctttagctaatttcaagttttcttcgaatggtagatgtgaaccatcgaacattactgaagtgtagcctagttcgatacattccaaagcagcttcgtagtcaccatggtctaagtggatagcaactggaacagtgatgttcattgcttcaactaaatcagtgatcaaatctttacagattttgtaaccacccatgtatttagctgcacccattgatgtttggataagtactggtgcttgttttgcttcagccgcttcaagaattgcttgagtccattccaagttgtttgtgttgaacccgccgacagcgtaaccgcctttacgagcagcttttaaaaattcagctcctgatactactggcataataaaattcctcctaagttttgtaaaactaaatttgttaagacaattcttaaccaacgaccctattttaccaaacatttcggtagttttctactaaaatcaatgaaaatgaaaattttcaagaagttttttgcaaaaaaataaaatgcttaatcgctctttacttaaaaaaagtcttttacttcctatctttttttctataaataataacaaatcagaaaaagagaaaagtgacaagaaaattgcttatcccctttctcttgctgctttcctctttctatcaagctaaaaaattattttgtttcatgatctgctaatgatgctccgacaaatgctttgattaatttttgcggacgatttggacgagaaatcaattctgggtggaattggcatcccacaaagaatttcttctctggcagttctacgatttctactaaacggttatctggtgagacacctgaaaagactaacccttgttcttcaaacatttgacgatatttgttgttgaactcatagcggtgacggtgacgttcttgcacaacatcagctccatcatatgcttcagccgtcttcgttccttttttgattttacatgggtataatccaaggcgtaaagttccacccaaattctcgatgttttcttggtcagccattaaatcaataatgttgtttgctgtatctggattcgtttcagctgatgccgcatcttccaacccaacgacgttacgtgcaaattcgacacaagccatctgcataccaagacaaatccctaaaaacggaacgtcattttcgcgagcataacgaatcgcttcgattttcccttctactccgcgatcgccgaaaccgccaggaactaagattccatctgcatctttcaaacgttcttctacattttctctcgttaattcttgtgctttgatccaatcgatctcgatgtctgagttataggcgaaaccagaatgtttcaatgcttcaactactgagatatatgcatctggtaactcgacgtatttaccgacaagtgcgatccgtacttttttcttcaagttcaagacacgttcttctaattctttccattctgtcatgtctgcttctggtgtatctagtttcaaatgatcgcaaacaatttgatccattccctgtgcttgtaaaactaacgggatggagtaaagtgtatctacatctggcgactcgataactgcttctggctcgacatcacaaaattgtgccaatttgtttttcacgctttgagaaacaggttgctctgtacgtaccaccaaaatattcggttggatacctaaaccgcgtagctcttttacactgtgctgcgttggtttagttttcatttctccagcagctttcaagtaagggatcaatgttgtatggatatacataacattatctgtaccgacatctgctttcatttgacgaagtgcttcaaggaatggcaaagattctatatcccctactgttccccctacttctgtaatgatcacatctgaatcagtcattttagctgctcgcatgattttttctttgatctcatttgtaatatgaggaataacttgaacagttgctcccaagtattcgcccttacgttctttacgcaaaacttcagaatagatttttcctgtcgtcacgttggagtatttgttcaaattgatgtcaataaaacgttcgtagtggcccagatccaaatctgtttcagcaccatcatctgttacgaatacttctccgtgctgatatgggctcatcgtccctggatccacattgatgtatggatcaaatttttggatagttacttttaagccgcggtttttcaataagcgtcctaaagaagctgcaacaatcccttttccgattgatgaaacgacaccgccggtcacaaaaatatattttgtcataagttcaaaaactcctttttaatttatgtgcaggaaaagtctcagaaaataaacaaagctccctattcttcaataagaatagggagccgaaatttctgtaaacttctgaccctttaaaagggtgcccaaggtgtataatacaagctgactgagggaaagtcaagtactcaaatgaaggctatccgcttacaatttttctttttcggtatcctttgagaaattatttcttaagtcctttatgagtgcaaaaaaatttaacccacatagtaggcttgagataaacatggctaacgttaaacttaagcaaatcaggaaatcttactgaaaaatttcaagtgaaacaatagataaaaaaataaggagggcgacaaacgtcgtgccccccttatttctaaataaatggtgttctcctgccaactcctcgctcacaagtcacaatatccagcaaacatgaaaagctgtttttggaaattgttccttgtgactcagagttaaacggcaggcttacgacctcttgataaacggtgttcaaaagccagtttctcggtattaagccaaatttatgcaaaaatttgaggaaccattttcacaaaatttttcttaatactcgaaactaaacgtctttttcacaacctctccactaaacggtgttcaatcagctgaccctcggtattagctcaacaaatggcaaaatatgaggaactattttgccgtttgtttctctaatactcaggtcaaaacgctgatttcacaacctctaattcacgttattcctgttttaataaagttctagatattgttctctttcccactcggaaacagtttgtctgaatgccgcccattcgagacgttttgcttcaacaaaatttgagaagatatgttgtcctaatgcatcaatcattacattatccttacgtaattccttgatagcattatggatagttgaaggtaagtcttggatatgtgcagcttctctttcttcctcatccatgacataaatgttacggtcaacagcggctggcggtgtgatctgattacggataccgtctagtcctgcttgcaacaacactgccattgccaagtatgggtttgcagatggatcaactgaacgcaattccaaacgagtggacaatccgcgagattctggtacacgtactaatggcgaacgattacgaccgctccatgcgacataaacaggcgcttcataacctggaacgagacgtttataagaattgactgttggattgcaaacggctgtataggcacgagcatgtttcagcaaaccgcctaagaaatgatacgctgtttcacttagttccaattcaccgtctttatcatagaagacattaccttcatcattgaacaaagacatattgcaatgcataccagaaccattgattccaaataacggtttcggcatgaaagttgcgtgaagtccgtgcttgcgtgcaatcgttttgacaacgagcttgaaggtttggatattatcacaagcatctaccacatctgcatatttaaagtcaatttcatgctgtcctggcgctacttcatgatgtgaagcttccacttcaaatcctaagctttctaattccaacacgatgtcacggcggcaattttcacctaaatctgttggtgcaaaatcaaaataaccacctttatcattcaaggtcgttgtaatcccaccgtcttcgtctaatttaaataagaagaattctggttcaggtcctaaattgaaagaggtaaaaccaaggtcgcgcatgtctttcaatgctcgtttcaaattcccgcgaggatcaccggcaaatggtgtcccatctggattatagatatcacaaattaaacgagcaacttttccatgagcactttcccatgggaagatcatccaagtagagagatctggatacaaatacatatcgctttcttcaattcgaacaaatccttcaatcgaagaaccgtcaaacatcattttgttttctaatactttgtcgatctggctcactggaacttctacatttttgatcgtacctaagatgtctgtgaacatcaatcgtaaaaatcgtacgttttcttcctcaatgattcgtttgatctcttcacctgttatctgtttctttaccatggtatccctcttccttttttaatttattcagtcaaagaactgtctttgcaatccttgcgactgataatgacctgttttgcctaacccaccttgcgccaaaatctcatcacgaaaaatttgtcgaacgtcatgatctgtcaacggcttcttgctttttgcttcttgttttttcgcctgtgccatttcgtatacacgtttgattccagccatgtttaacccgtctgaaagataatctttgatctcaagcagcatatcgatatcattcaacgaatacatgcggcgatttccttcacttcgttccggatgaactaaatcttgttcttcatagtagcgaatttgccgagcagacaaatcagtcagcttcataactgtaccaattggaaatacggacatagatcggcgcaattccttttctcccatcagacgtcccctttcgttttataagttggctaaagtgtaccaattaaaaaaaatattgtcaactgcatatgttaggttttctaacatgagatccctatttttttataaaataacaaaaaatatgaacgaaaaaaaaggtatctagttgattttcgtaccagataccttttacttttattgtactacgctattctttcccagtgatttttattgtaaaaaaacaaaattttatttgctttttctcaaccattttgaatcattttttgcaaagcctctcacttcatactcgtttgattcttccatgtaggcttcgtccaaaaccatcgtttgtcttcttaactcacttaatttctgtccttcattgcttggcacagacagtgtataaggtgtcatcagttccatcagttgacgcttgattgcttcgatcaatgccgtcttcccttctttcgtttgagcagaaatcaatacattagggaataatgtgggtgtaaacatcgctggatcaatctggtctgccttattgtaaacagtcagtatcggcatttctttcatattcaattcatccatcaattttagtacagtctgctcttgtaaaatgcgatctggagaactggcatcgactacatgcaacaaaagatccatattctgactttcttctagtgtagaatggaaagcatcgatcagttgcgtaggcagatcttggatgaacccgacggtatctgttactgtaatctcaaatccttcagcaaaacgccatcttttagtcaatggatctaacgttgcaaacaactggtcttttgaataagtatccgcttgtgtcaataaattcaagatggttgatttcccagcattcgtgtagcctataagaccaatctgaaaaatctcactgttttttcttttttgacggttgcgctctcgatgggcttctacttctttcaattctttcttaacagcaaaaattttattccgtatatgtcgacggtctgtttctaactttgtttcacctggtcctcttgttccaatcccaccaccaagacgagacaatgttttcccttgccccactaaacgaggcagaagatattctaactgagcaagttcaacttgcagctttccttctttcgaacgagcacgcatcgcaaaaatatctaggatcagctgtactcgatcaatcaccggaaggccaacagcatccgtaatcagttgactctgtctcggagtcagttcatgattaaagatgatcaaatccgcttcatgcgcatctgcttgttgaactaattcttgtaatttccctttcccgataatcgtttgccgatctacttgtggtcttttctgtgtaattgtgaatacaacttctcctgatgcggtattcgtcagctgaactagctcttccattgactctgaaaagtaacgttggtttgcttcggtttctacccctacgatgattactttttcttccattttattccgcctccagccattttttgattgtttgctcaatctgacttttttgatttggctcacttataagatcaaaccactgtgcatccaaacggttacgaaaccacgttaactgacgtttcgcgtatcttctcgaatgtagtttgacttgttctgttgcttcttccaatgtttctttcccttcaaaataagggaaaaattctttatatccaatcccttgactggcttggacttctccaagctcatataccttacgtgcttctgctaccaagccttctgctagcatcaaatcgactctgtgattgattcgatcatacaggacatcacgcttcgtatctaacccaatcatgaggtaatcatataatcgctttggctcttctttaggtgccgtgatactatgccctgtcgtctccaaaacttccagagctcttatcactttgcgttgattgttccagtggattttctcagcagctgccgggtctttttctttcaactgattccataacgcttgggaaccaattgtctcggctaacgtttcatacttttttctaatctcaggattcgcttcttccgtcgcccctaactggtaatcgtatagaagggattggatatacagacccgtgccaccagctatgataggtagatgctctcggttcgcaatctcagtaatcaattgtcgacctgaatgctgaaaatcagcggctgagtaatgttgagtaggttcgatcacatcaatcaaatgatgcggaacatcattcatctcttcttctttgatttttgctgtaccgatatccagatttttatagatttgcaatgaatcaccgctgatgatctctcctctaaatagttgtgcgagttccacacttagcgctgttttaccgactgctgtcggaccgacgatcactaatactttttccatattttacctacttttcattgattgtttccaccgaagagctttctccggaaaatcagttattattccatctattttgagttcttgacatttggccatttcttcttcatcgttgatcgtccatgcacgaattgcttttggaaaatcagctgcttggcctggatgttcgaacaaccaagtattttttggatgtactccttctatataaggggtttctgctgctagttggatctttttatcagaagtactcatcaataagtccagctgtatctctggttccaataacgcgattttttccaaagaagccaaatgaaagctgcaatatgcatgttgaaaaggccaatctctgctttttaatgtttcggctaatttttcttcgataccgggatattcatactgatcagttttaatttcgatcatcagcatccctcggtaatttttttggagaagcagtcctaaaacttctttcaattcagggactttagctgctggaaattctttgctgaatttgcctcctgcattcaattttttgagttcttccaatgttttttctcgaatcagccctttaccgttagtcgtccgatccacttcttcgtcatgcataacgatcaaataaccatctttgcttagatgaacatctaattcgataccatctgcacctactcgtacagcttctgcaaatgcagggagtgtattttctgggtgggtaccgctacttccgcgatgagcatagatttgtaacatctttcttcactccgttcagttctattgtatcattaagaaaaaaagaaagcattgccacgctctcatgtgcaacggcaatacttcaaaatatcagctccaaacatcatctttcgagaagaaaccaatcggctggcgcgtcatagtcttcaactgtgcttttttttcattgatcatttcagtcaaactatccgtaaaattctctaaaatcacgcgtccgcctttataagcatatccaccaatcttcattgtttcatctggagataaaatcacttttcgatgggagatgttcttaaacagctcatctaaaatataatttggcagataaaaactattctgcgctgaaaatgattggagatacgcaaaatcgtcaatcgtgatataacaatcatcgaatgcatcaaagctgacatattcttccatcagcgtcgtccgtttttgcaaaatctcgttgatctttttatttaactggttcagcgtctcgatttctttgactttcaattccaattcacgtctacgctgttctttattttccaagtgacgcatttgcagtatcatgccgatatagacaactacagcacccgtcaacacgccgataagaccggtaataccaactatcaatctgttgttcctccttgttttgcttctctgcttatcataccataaagcaggtttatgcgactaatttgcctaagttttttatttgaccttttttgaccaaaaatgtatactactttttaggtattagaaactaaattatggtacactatttctaaacgaaaccaaggaggaactctattatgaatttaattcctacagtcattgaacaatcatcacgaggcgaaagagcttacgatatctactcacgtttattgaaagaccgtatcatcatgttaagcggtcaagtaactgatgatcttgctaattcgatcatcgcccaattgcttttcttagatgctcaagattctgaaaaagatatctatctttatatcaattctcctggtggttcagttacagcaggtatggctatctacgacacaatgaactttgtcaaagcagatgtccaaacaatcgttatgggtatggctgcttcaatgggaagcttcttgctgacagctggtacaaaagggaaacgatttgctttaccaaatgctgagatcatgatccatcaacctcttggcggcgctcaaggtcaagcaactgaaatcgaaattgcggcacgtcatattttacaaacacgcgaacgcttaaacaaaattttagctgaacgcactggtcaaccgcttgaagtgattgaaaaagatacagaccgtgacaactatatgacagctgaacaagcaaaagcatatggattgattgatgaagtcatggaaaacagttcttcattaaattaatctgtttcaaaggaagctttttaagctctcttatctaaaccaaaaaaaggatggccagctcaaactgaccatcctttttttatttttatggatgctactgcctatctttgctccttgaattttccttgcgcatgcatccgacctatttcgacataatgctggatgttttctttgtttttttggatttcttcttttgtcaaaggccggatcactttagctggacgaccaaaagccaagacattaggaggaataacttttccttctgttactaatgatccagcaccaatcaaactattctcaccaataaccgcatgattcaatatcgtggttcccatcccgatcagcgcccctttttcgattgtacagccgtgtagcatgcactgatgtcctaccgtcacattctccgcaatatctacaggtgcatcatgatcgacatggacgattgtaccatcttggatattcgttctttgtcctacttttatccaattactgtccccgcgtaaaactgcttgataccagatcgtcacatcttctgacaatgtcacgtcaccaatcactgtagcatttgatgctataaaccgtttcatctctattttctcctttcgtttttttgtagaaactaatcctattgaataaatgtatcatagcatatatttattttataagaaaaaacaggtaaaacctgctcagtccagatgcctatttgcgctatctggtaaactgacgttttacctgtttattgtacctctatattttcttctattactttcttcaaaactaattcgtacacttcgatttgtgctgccaagcgttcgatttgaaactcattttcaaaaaaatcagctgaatcaaatggttttgtctgacagacgtgcgttaaacgtcaatttctcttttggcttcagtgattttttcatttaaaaactgttccatctccgtgccctcactttttttgataaccttactttaccattatcaagaaaggagaacaaaaaataagtttcaaactgttttatccttctatgatttatcctgcttcctcagcaaattggctgttatacagtttttcataaaatccgccttgtgccaataaactctcatgtgttcctttttcaatgatctgaccttggtccatcactagaatcagatctgcatcgcgtatcgtcgataaacggtgagcaatgacaaaacttgtccgcccctccatcacgcgatccatcgctttttgaatcaacgcttctaaacgagtgtctactgaacttgtcgcttcatccaaaatcaaaattttaggatctgaaaccactgctcgggcaatcgtcagcaactgtttttgtcctaaagacacattgtctccctcagcattgatggccatctcatatccatctggcattgtccggataaaatggtctacgtttgctgtttttgcagcatctactacttcataatctgtcgcatcaagctttccaaaacggatattatcggcaatcgttccttgatagagccatgcatcttgtaagaccataccaaacagggaacggacatcactacggctcattgatttggtatcaatcccgtcgatcctgatagctcctttgtctacgtcgtaaaaacgcatcaatagattgatcaaggtcgtcttgccggcaccggttggaccgacgacagccacggtttgacctgctttcacttcaaagttcaaatcttgaatcaatggtttcttcggatcatacgcaaaatcgacatgatcgaatgtcacatctcctaaaatcgtttctggcagtgaaacatctactttgttttctttttcttctggctcatctaaaatctcgaatacacgttttgttgccgctgatgcactttgcaaaacagaagacaattgtgtcacgttccccatcggctggctgatttgccaaatatattggatgaacgcctgaagttgaccaacaacgattgctccagtaataacatagaaacttcctagaacagccataccaatataagtagcataggcagttagttggactaatggcatcatcaacccagaaatgaacgctgcgcggaacccaaagtatttcaagctgtgatttacttttttgaatccttccaatgtttctttttcgcgtccgtatactttcaatacactgaaacctgtcatattttcttgaacgtagccgtttagctcaccaagcgaattctgcatgctttgaaaatatttctgcgaagcattgatcactcgtttggagatccagaacgatgttggaatcatgatcatagagatcagcgccatcatcggctggatataaaacatcattgctgcagccaacgtaattcccaatatcgcatttacgataccaataaaagcttgttgtaaagcaccgctgactgcatctacatcattcgtcacacgagacaaaatatttccttgctggtttttatcgaaataagaaaccggaagacgattgattttttcttctatgtctcttcgcaaatcatgcatggcactttgaacgacatttgtcatcaaaaccccagaaagcaattgcgaaatacaataccctattccgaccactgtgatccaaataagacatttgaatatataagaaaaattgattgattcgccattggcaatattacgactgatttctgtagtaggaagtcctgtaacatatggcaaagccacgttgaaagccactgtcagaactgtaaataggatcactagaagaaaagtcccacgatacggtctgatatatcgagctaaacgttttaaggaagaaaaggtttttttcatgctagttcctcctttgataattgagaagcggcaatatcataataaatcgggcatttttccaacaactcccgatgtgtccccataccgacgacttctccttcatttaatacgatgatcttatctgcatgcatgatcgttcccacacgttgtgctacgatcaatacagtagattctgttgtttcttttttcagacgagcacgtaacttcgcatccgtttgataatctaatgctgaaaagctgtcatcaaaaatatagatttccggacggcgtatgatggctctggctattgccaatcgttgtttttgtccgcctgaaaaattggaaccaccttctgataaatgttcgtcaaatccatctggttttcgagaaatgaattctgaagcttgagcaatctcagctgcacgttccatttcttcttgtgtggcatcttctttcccatatcgcaaattatcggcaatcgttccagtaaatagcagcgctttttgcggaataaacccaatcttgtctcgcaacttgcttaaccgataatctctcacgtctactccgtcgaccaagatctttccttcactcacatcataaaagcgaggaatcaattgaatcaacgtagattttccgctaccggtacttccaataaaagcaacggtttctcctggagaggctgtaaaactgacatttcgaatcactggctcttgcgaatggcctggataagcaaatgttacattttgaaattcgatataccctttagtcttcgtatccgatataccatttggatcttctacaatcgaaggtttggcatctagtgcctcttggatacgtccagctgaaacggctgctcttggatacatcatgaacacactggcaaataacatgaatgagaataaggcatggaatatatactcgataaatgcaatcaaatctcctacccgaagttcgccagcatcgatttgcactgccccgctccaaatgatcaacaccatcacgatattaaataagaaataaaaacctggttgtgcaacagccatcaaacggaacaagcttttcgaactagcagcataattctcattgactacagcaaagcgtttttcttcaaacttttcattgacgaatgcacgaatcacacgcaatcctgaaaggttttcccgcaagatactattgattttatctaagtttttttgttgttttttagataacggctcagacaccttagcaatcgctacgaccgccaataatagcaaaggcaatgcgcctactacatacaagctgagtgtcacacttgtacgcatgaccatgtacaaactgacaacgaacatcatcggcgccatgaaaccgatacgtaaaatattttgcaggaacaacatgatctgataagcatcatttgttgtacgagtgatcaaggaagatacgcctaaattttcgtactcctgatgcgaatagctttggatcttttcgaacaagtcatctcgaatatctgctacgatattggtcgtgatcctcgaaccaaaataacctaacaagatattcaaaataataccgattacggtaataacgatcataaatatcccttgctgtttcacataatcaaaatcaccattgcggattcctacatcaatcatacgcgctaaaatcgtaggaagtcctaattcaatcaaaataaaaccgaatacgcatataaaattgaaaaacaagaatttcttataacgcatggtataatgccacattagtttcactttctcatctccttttaatcttttgttacattttcattactaaaaatgatagcacaacgaacctattaatagaacacttctctcataaaaaagtcattatgattatagtaaaatgataaacgttgattttttctttcaatctagttgatttctatacttatttgctgttttatgctagaataacaattaattgttgtatattttttatacagaaggtacggttgaaaaaatatccgaacagatgagcaaaaacgaggcttgtctctttgactcgaatccagtattctagtcaaagcatatgaaaaactaggtggcttgtcccctcgttttgtgttgtctaaaaaaatcaactagctaaatcactgctttacgcagataaaggagacaaaacaatgatctataaagtttattatcaagaaacaaaagtacgtaaccctaaacgggaagaaacaaaatctctttacattgaggcaaaaagcgatgtagacgctcgccaacgtgtggaagaaaataccccatacaatattgaattcgttcaacttctagaaggaagtcatctagaatacgaaaaagaaaatgctgatttctcattagtggagttttaatatgaaactttccatcaaaaataatgagacaggcgtctttgctattggtggattaggtgaaatcgggaaaaatacgtatggggtacaattccaagatgaaatcattttgattgatgccgggatcaagttcccggaagacgatctacttggaattgactatgtcattcccgactacagctacatcatacaaaacttgcacaaagtaaaagccttagtgattactcacggacatgaagaccacatcggcggaataccctacttgctaaaacaagcaaatattcctatctatgctggtcctctcgcattagcgttgatcacgaacaaattagatgagcatggcttgcttcgagaggcagagcttcatgaaatcaatgaagatacgattattcgttttagaaaaacttctgtcagctttttcagaacgactcatagtatcccagacgcattagggatcgtggtaaaaacaccttctggtaatatcgtagcgactggagacttcaagtttgatttcactcccgtcggcgaaccagcaaacttgcataaaatggctcgtatcggggaagaaggtgtcttgtgccttttatctgatagtacaaatgctgagattccaacatttactaaatcagaaaaaacgattggtcattctatcttgaagatcttttcaaaaatcgaaggtcgtattatttttgccagctttgcttctaatatcttccgtttgcagcaagcagcagatgccgctgtggcgactggtcgtaaaatcgctgttttcggacgtagcatggaaaatgccattgtcaatggccaacgtttaggatatatcaaagttccagacggcacatttgtagatgcacatgaaatcaatcgcttgcctgctaacgaaacgatgatcctatgtacaggttctcaaggggaagcgatggccgctttgagccgtattgcaaatggtacccaccgtcaaatccaaatccagccagacgatacagtgatcttttcaagttcacctatccctggtaatacaacaagtgtcaatcatttgatcaacttgctgtctgaagctggcgcagaagtaatccatggaaaaatcaataacatccatacttccggtcacggtggacaagaagaacaaaaattgatgcttcgcttgatgaaaccaaaatattttatccctgtccatggagaattccgcatgctgaaagtccatgcttctctagcacaagatgtaggtgttcctgcagaaaactgcttcatcatggaaaatggcgatgttttagcgttaactagcgattctgcacgtcctgctgggcattttgtggctggagatgtgtatatcgatggtagcgggatcggcgatatcggtaatgtcgttttacgtgaccgtcacctgctttcagaagaaggtcttgtattagctgttgcaacagtagatatcaagaaaaaagaaatcttggctggtccagatattctctctcgtggatttgtctacatgcgagaatcaggagaaatgatcaatgaagctcagcgaatcttattccatgctttaagagaatgtttaaatggacctgactgttcagaatataaattgaaagaagcgatgactggcgcacttcagccattcttattcgaacgtacagaaagacatccaatgattttaccgatggtcatgacaccagatgaagaataagtaagagggtgtgaaattagtgccctgacctgagtataagagaaaccgaacggaaaacaggacaagttgtttttatttggctgttcttattgcttgatacagggcagctttttcacaacctcttaaaatttatttactttttcatacaaaaaatacctgccacaagagaaatttcctcttgtggcaggtatttttgttactcgctttgttctctcgtaaaaattgatgcctaccatcaatttgatttacagataaaattaagcttttacaacgtttgcagcttgtgggccacggtctgattcttcaacgtcaaaagtcactgcttgaccttcttctaatgttttgaatccgtcaccttggatagcagagaagtgtacgaatacgtcgcttccatcttcacgtgagataaatccaaatcctttttcagcgttgaaccattttactgttccgttttccataataatatcctcctcgtgccaaaagcacttatttaaattgtaacattgctcgtgtacgatagaggtgcaacagatgtttcaacttctattcccaaacaaaattacaatataattgtacacttgcttcattttttttgcaagaaagcaacttacttctcttccattaatccttcttctctcaaactaaaatatcgtttacgtccgatgatcaaatgatccagtacagtgatgcccatcatttctccacacttttgtatccttttagtaaaattcatatcctgttgtgatggaataacattaccagaaggatgattatgtgctaaaacgattcttgccgcgcagtaacgtacggcataatggaatatttctctaggatgagcgactgactgattcagcgaaccgatgaatactgtcttttttaagatcacttgattcttcgtgtccaaataaatacaaatcaaatgttcctgtttgtgatctttcatttccagaatcaattgttgtgccagttcatagctagtacgaatggcgggagatgctctttcttggtccgtctgaatgcggcggcctaactcgatcaaggctttgatttcgattgctttcacacgtcctatccctcgaatctcttctaactcatgcaaagtagcctgtcgtaaagaagccaatcctccaaacgtttttaacagattgccagcaatcgacatcacactatgagggtgctgaccagtacgcagtaaaattgctaaaagctcctgatccgataaagcttcagctccataaatttccatacgttcccttggtaaagagctagttggtacttctttgatcaatcgtttttccaaaaaaacatctcctttctatcttttctaaaataagatacgaaaagagatggatttttattttatcaatgcagggatttcatgcaaagaagaaacgaccccagccgtttttttgatcaattcttgggaaggcggaagcaaatctggaaccatgactacagggatctcagccgcagaagctgctaaaataccattttgtgaatcttctaaaatcaatgtttctttcttagctgtacctaatttctgattggctaataaaaaaatttccggatctggttttgctcgttggacattctctgcggaaacaatcgtctcaaatcgttcaaacagattgttcttcttcaataaaagttcaatgacagctcgttggttactggaagcgacaactttgggaatctgatgttcttctaaaaaagagaggagttccaacacaccgggcttcatttgtacggctccttttgaaaagcgctcaagcgtttcctggtatgaatcgtctatgaatctttgtacgcttgttttaccgaattccgcaaaaatcatatgataattcgcccacacttcttcatcggaaacacctaagaattttaaatacaggtctttatcataaggaaaacccatcctatctgctactacttgtgaagcctcgtaatatactaactctgtgtcaaacaataaaccatccatatcaaaaatcactgcattatacttcatggtctcctcctaattgtattaataaatgacgaacttctgaaatgaaataaagcgaaccggtcacaactaatacatcttcatttgtcatcttttccaatatatctgctaatccgaattgccacaatgaaacgattgatactctctcacttgctaaatctgatacttcacttaattcgatggcttttggatgttcaaaggtcgtcaaataaatatggacatttggtacttgttgcagtcgttctagcatttctctaacatttttagttcgtaaggcggaaaacaaaatgttgatttgatatcctttgaattcttttttcaaattctcaacaagccggttcattgcatgcgtattatgggcaccatctaaaacaactaatggctcgttactcaaacgctccattcttcctggccatcgagatttcttcaaccccttcaaaacatctttttctcgaaaaggcagcttttccaattgacagtaaacaaaatacaattcgatggctactcctgcattttcagcttgatgttgccctaaaagcggcgtggttagttgagggattttccctgcttcattaaagaattcaaatacttctccccaagtctcatcaggatgcagatagtttattttataattttccccgtatacataaagcatcgcatttttttctttagctgtttgtttgatgatattaaaagcttctgggccgatgtttcctgtgacaactggaacgccttgtttgatgattcctgctttttgcgcagcgatttcttcaatcgtctctccaagtatctcggtatgatcaagcccaatcgttgttattccagttagcatcggtacagctacattggtagaatccaataagccacctaagcccacttcaataatcgctacgtctactttcttcatcaaaaaataatcaaataccattgctgttaatgtctcaaattcagtgataccagctactgcttcaaattgatcaagttgtttgatcagcggctgatatttttttacaagctggatcaagtcattgtctgggatacttttgccattgattgcaatccgttcattgaacgtttcgatataaggtgaagtaaacgttccaactatcagaccagcttcttctaataggcttctcaaataggctacagtagacccttttccgtttgttccagcgatatggatcgtttttactttcctctccggatgacctaccacttctaataaagcttcgactcggtcaagaccaggacgtgaaccaaatggtaatcgactatggatccattctattgcttcttcaatcgtcatcaacaattcccccatttctcttttattataacaaatagaagacataagaaaaataaaaggacgatagagagaaaaatctgctccggatacatgataaatcgctcttttttctaagtaatcagagtagactaaaaaagaggatgcgacaataatcatgtcacatccccttatttggaataagtggtgttccccgcttttattgaatagtacgcaaactttcgattcgttctttgacagccgtttgcttctctaaataatctttttcttttgcacgttctgcctctactacttcttccggcgcattagaaacaaaccgttcattagaaagttttccttggacacgtttcacttcgcttgtccatttttccagttctttttctaatcgtttgatttcctcttcgatattgattaatcctgctaacggcaagaagatttctgcacctgtcagaacagctgacatcgctagatctggtgcagtgatctcacttgatatcgtcaactcttctgggttgcagaagcgttcgatgtagcttgtattttcaactaaaaattgatcgactttagcatcgtttgttttgattaataatgtgattggtttagacaatggtgtattcacttctgaacgaatatttcgaacggctcgaatcaattccttcaatacttccattcctttagaagcagtttcatcgtcaaactctggacgtaccacaggatattctgctactactagagaatttccttgatgaggaatatgttcccatatttcttctgtgacgaatggcatgattggatgcaacaaacgcaaaatctgatccaaggtatggactaggatactacgtgttgtttgttttgaaacagcatcatctccataaagtacttctttgctcatttcgatataccagtcacaaaaatcatcccagataaagttatacagttgtctaccggcttcaccaaattcaaaacgatcaaataattcagttacacgtgcgactgtttcgttcaaacgtgtaagaatccaacggtcagccactgatttttctccagataaatcgatctcttctacggtcataccttcgatattcatgataacgaaacgtgaagcattccagattttattgataaagttccatgaagcatccattttttcatagctgaagcgaacatcttgtcctggtgcagaaccattcgataagaaccaacgaagagcatctgctccatacttttcgattacttccatcggatcgatcccattacctaatgatttactcatcttccgcccttgttcgtcacgaatcaatccatggatcaagacattctcaaatggtcgttcgccagtaaattccaaactttggaatatcattcggcttacccagaagaaaatgatgtcataaccagttactaaggtgctagtagggaagtaccgcttataatcttcgctttccgtgtctggccagcccatcgttgaaaaaggccacaatgctgaactaaaccaagtgtctaaaacatccggatcttggacccagttttcactatcagctggtgcttccatccctacatacatttcacctgtttctttgtgataccatgcagggatttgatgtccccaccataattgtcgtgagattacccagtcatggacattttccatccaacgtaaaaatgtttgattgaatcttggagggaagaattccactgcttgatctgtttcttggttatcaatggctttttttgctaacggcgccatttttacaaaccattgagtagacaatcgaggttcgacaacgacacctgtccgctcggaatgtcccacactatggaccatcgtatcgattttgatcaatcggccgatttcttttagatcttgcacgattgctttacgagcagcgaaacgatccattccagcatattttcctgctagttcattcatcgttccatcatcatccatcacattcactcgtgggagatcatgacgattacctacctcaaagtcgtttggatcatgtgctggagtgatttttactacacctgtcccaaactccatatctacatattcatctgcaatgattgggatttctttattgactaaaggtagaatcacttttttgccgatcagcgcttgataacgctcgtcttctgggtgaacagcaatcgccgtatctcccaacatcgtttctggccgggtcgtcgcaatttctactacgcctgatccatctgccagttcatagctcatatggtaaaaggcgccttcgatgtctttatgaataacttcgatatcagatagagctgttcgtgcttgagggtcccaattgatgatgtattcaccgcgatagatcaaccctttttcatataaggtaacaaaaactttacgtactgcttcagataatccgtcatctaatgtaaaacgttctctgctgtaatctaaagataagcccattttagcccactgttcacggatatggtttgcatactcttctttccattcccacacttgatcgatgaacttttcacgacctagatcatagcgagaaattccttgctctctaagctttgcttctacctttgcttgtgtcgcgattcctgcatggtccataccaggcaaccataaagtatcatatccttgcattctcttttgacgaatcagcatatcttgcaaggtcgtatcccaagcatgccctaaatgaagctttccggtaacatttgggggtgggatcacgattgaataaggttttgcttttttatctccgctcggtttaaacaaatcttgttctaaccaatgctgataacgtccagcttcaacttcttgcgggttatattttgttgataggttattttcttccgtcatgctgttttcctcctttaaactaaaaaacgtcctaaaatactttcgtattttaggacgtatgatttacgcggtaccacctaaattgcaataatcaatcattattgcctctccagtgagttaacgatcacgactcgtctatctctactccattcaagacagaaactcccaagctaccttcactggttgtcattgagaacctttcagcagatagttctctctctaagaatgaatgtgccagttactcctcttgttcagcgttatgcttcattctacaatggtttttttttttagtcaacaagtggtcgtgaaaaaaccacttcatttagtattaaaaaatttttgaaagaattacaatggatcctcgcaagatcaataagcctactcaaattttcctaagaaaaaacttctgagtaattctcatcaaagtaaataagcgtctgtaactcggttgtcaaatcaatgtattgaacattgacataagctgggacagttactcggtcaggtgcaaagttaaggatagcggttacattccctttgacaatttcatcaatagcagattgtgaatatttacttggtaccgtagagattgctactgtcacattttttgctttggctatctccgcgaaacgatcaatcggatagatcatctctccatcaatgactcgattgatcagtgctggatcattatcaaagacgcacacgatatttagattttcatttcttctaaaattgttgtgtttcaatgctttgccaagatttccgtatccgactaatgcgattcgtttttcttctttagtattaaggatattattgaatacatcgataaggaaagggacatcatagccatatccgcttctgcctagctcgcctaattgcgagaagtctctgcggatcgttgcagaaggaatttgggtgatttcgctgaactcatttgatttgattctacttatgcctgagtcatccagcatctttaaatagcgtaaatataaaggtaaccttttcgcagttgcttttggcagtgtatctgttttttctcgcataacgacgctccttgttaataatttcacatatttagtgtaacatgtttctaacccgggagcaaggttacaggtaggaaggaaaagggtgtgagacaaataaaacgacccaaaaattaactatttgggtcgctatttcatggaaaattctcttttttatcatttatcagctaatcttcgacattagttcaaaaacggtaaaatatatggagctatttttccgttttgtttctctaatactcaggtaaaaacactgatttcacaacctatagcaattctgaaaattcttcagttttttcattagaagattctgcttgtatctcttccatcttcaagccagctagtgctcgttggatcatttcatctattgctaaacgctcttcatattgatggaccttttccagttgagggcgtgtttttggctgtggaggagcaaaaatcgtacagcagtcttcaaaaggctggatagaaagattaaatgtatcgatctgttctgctacttcaatgatttcaagtttatccattgtcgctacaggccgaatgattggcgtattcgttacttcattgatagccaccatactttgcaaggtttgtgaagccacttgacctaatgattcgccattcaaaataactagaccatgacgaatacggcgaatttcatcggtcaaccgcaacatcattcgacgagtgatcgtcatccaatatccttgtggcactgattttttgatttcttcttgaatctcggtaaatggcacttcaataaaatggattgttcctacataaggtgctagtttcgctgttaagtcttttgctttttgcagtgcttgttcacttgtatacggcggactagcaaaatgaacagcttcgatttccactccccgcttcattgcaaaatatcctgcaacaggagaatcaatcccgccagaaagcatgagcattccttttccgcttgttcctacaggcaacccgccagctcctttgatcgtttcatacgacagataagcgccgtcacgacgaatctctacacgtaatggaatatcgggctgacgcatttgaacttggatatgagggaaaatatcaaaaacagcattgcctaatgtttgattcaattcattacttgtcaattcaaattggtgatcgcttcttttagcgataattttaaatgtttctttccctgtataaatttctttcatgatgtcttgaacagcttgtttcaaaacttcgacatctttttctacccgaatactcggagaaaaattttggatcccaaatatttttgctagttttggaataactagctgactgtctgcaccattcaacaaaagatgcatccggtcgcgatcagcatggattttgatttctggaaattctttcaaagcttgtctgacattttgtgctagttgcatgataaagctttttcgattctttccttttgtcgaaagctctccataacggaccataatttcactgtatttcacaagaacactcctcttttaattgattgcagaaaatttcttataaagctgcttgaaaataatcataaattgttccacttctgctaatgaattattttcatctaggctgattcgaatagcagatgtagccaaatcatttggtacatgcatcgcgtgcaatgtactgcttgccatatgtttacgtgaggagcaggcactagtagtagaaacaaatatttgtttttcctctaaagcatggacgagaacttcaccacgaattccttttagagcaaaacataaaatatgcggcgcatagtcggttccttctgaaaagatcgtcactttatcatacgacttcagcgcatggatcaaagcttcttttaagcgttgtgtctgctcaggtttttgttcctttatctctaatgataaacgtaaagctttagccatagccacaatacctggaacattttctgtcccacttcgctgatttctttcctgtcctccacctgtcagtaatggtgctaaacgacgaccctttttccaataaatgaaaccagttccccgtgggccatggaatttatgggctgaaaatgttgcaaaatccactctccctgtcaaccattgcgagaatggtacttttccgattgcctgaacagcatctacatggaaatgaattttagggaaatcattcaaaagatcactgatttcttggatgggctgaatcgatcctacttcattattcacagccataacagagaccaaaactgtctcttttcttattaattttttcaattcgtcaacacgtacaaaaccgcgtttatctactggggcgatacttacttcgattcctaattcttttaattgttcggccgtctcactgactgccggatgttcgattcctgaaatgatcatatgattcccatactctcttttttcgatcatcgttccttttaatacccaattatctccttctgttcctcctgaagtaaaaaagatttcttctggttctgcatggatcaaatcagcgatctgctttcttgcttgctgcaacaaccgattagcttgattgcccaaatcatgaagacttgatggattcccaataatccgctgactggtttttacgtatgcatctaagctttgcggaaagattggggtcgttgcactgttatcaaaatatatcataagaaacccctcttttttgaaattcttttctattataacggttgtccaaggtgctttcaagagcaggtggaattttcacttgtttcgtccttcggatagacataaaaaaagacaagaacaagacggatggttgtcttgttcttgcatgattgctgcttttttgctttatactaagtctggatgattaaaataaaaatcttcgatgcgtttgaaagcacctggttctactcgctctaatgctgtaccaatttcgtctaatgcttcttgatagtgatattctttattgaataaatagtaacttttatcaattgcttctcgcacttcttcgtgtgtatgacgataacggtttgcatattggagcatttgctccgttagtgctgctgcatctactagatcatgtgtcttcttatctaataattctagatcttcttcgcatagagcaactaaacggttgacttcctccatgtttactcgaattttattcaagacaacacttagttcttcaatacgatcagtagcaacaaaaaagaattctaggtaatcattcggcaagccaggcaaacgttgtttctctacaaaacgtttcaaactacgcaatttaaattcgaatgtatcgatcttttcttgcgcttctttttcgccttttctcaattcatgtaatgagtcatcgatctctacttgttgcgtttcgatatcttctaagaccttgaagactgttttatagaacgtacgcacttctgaataagggatttcgtgttggcgaatctgtggaatcatctgttcattttgacgttccatttcttccacttcagtttggaaacctcgtacacgaccaatttcattgtgattcaatgtatagctttgagcggtgtgatccaactcaatcaataattgacggttattcttcgttgtatgtttgatatactctgtaatcgttgattggttagtttttacatatctctgagcttccatttcccgttctaagatgtcatatagcgaatcaatcaaatcagctgtttctcggttttcgaattcgaccgtttcaacttctgttttttcaagattggctaatgaattttcaattcttcgacttacttttgcgatatcttcagcaagatcttcttcagggaatacatattgttcttccattaatttctcataagtatcactgatttcttcaagttgttcagggaaagtcgtatggagatcttcatacagtggtggaatttttttcatcagagcttccacttcatacgtatgtttttctgctttatctaaaacctcgcgggcctctacaggatcgccggaagtatttaaagtcacgaattgcgtaaattctttttcgatcatcttgatctgtttttgcaattcaaaaagagctggtccatattcatgctcgtcttctctgactttttctttcagttcttcatagacatcaagcgcctgctggacagctaatgagttgcgttcttctgtttctcgcaattccttcagaccttcacggatttccgttacttgtttctccatttggtccattgttgcttctgcttcaacaactgctttttttccttttaagaaccgaaaactttcattgaggttttccacttcaaaaatttgactttctaattcagcgaatgaggaagtagatatgtcattccacttttgactccattcacgaaaggtattttggctttgcccaaccagatgcattttttttacatcatcgacttcttcaatcactggcaagtcaaataattcttccttgcgtttttctaaggcatccaatcgatcttggttttttttcttcatcaagtaactaaccaaaaagacgacaatggcgactataatgattgcaatgacgattccgatgataacattatttcccatttatggttcctccgttttcagtatgcatctttttatgcaacagatggcgttctgcttggcataaatccaaataatacgtctctcgtgcaaaagacatctattctagattatagcatactattttcatgcattcactaacttaaacgaaaatcttttgtttttcatcgtataaagataacaaaaatagtgaagtactgatcactctctttcgtttgtgcgtgcactcctatcagcagagcttttcccagcaagagcttcttgaatctgtcgttggatttctgccgcgattttaggctctggcgcgtactccatctgccagttctcaggtttcaatactttatttgttacaggatcataatgaggttttccatctggaaacaattttcccatatttgcctgatggacgatatcaaatattcgatcaggcgctattcccaataatgaaaaagaaccataagtaaagtaaaggatatctgtcagtgcatctacttgttcaatcagtgggtcacttccccactctgttttatcaagtattttttcttctgctttatctaatgcttcgtgtagcagagtaacagcttcatgtagttgttctttacttggtgaggtagctgcaacaaattcaacaagttcttctattttgaatgcagcacgtgtatgagcctccatcgcagtaaaagctgtggggatttctggtcttcttggatcaaaaattttgtgaaatgcttctactttttgaaaaggtgtctctgattccatactaatgttttccttctttcattgactaataaatcagaccaaagtgtttcagtccttcgtatatgccatcttcttcatttgattgggtcacaaaatctgcggcatgttttacttcgttctgagcatttcccatggccactccaattcctacacctttcagcatctcgatatcattgtaatggtcgccgaatgccatgatttcttccatctcgattccgacagcatttgcgaaagcttggatgcctagcaattttgaaccaccttttgggatgatatctacagtatacgtatttgaacgttggaaggtacactcaggaaatagatgttctaactttttctgttctgactccggactaagcagtatacattggtaaattggttcttttaatatctctaatgtttcataacggtccttttgccggtgagggctaaaaagctggaggatttttttcatcagacgtaccgggaatttacgcggtaaaaagctgactagccgcttgataaaaatcgattgtcctaatagcatcgtcgttgatccatctagccgatttctcgcaccaaaaacgatttgtcgatggttctcatctgcaaattcaacaatatgttccaatactttttgttcaaaagggtggtcgataatcgttcgatctgcagtaaaaaccagttggccattatacacgacatacatatctaattccaattcatcaatgatttctttgatctttattgggctgcgacccgttgctacaccgcataaaatgccgtttttccgagcataattaattgcttgttttgttgattccaatgcttttgaacgattggtgaccaatgttccgtcaatatcaaaaaaaatagctttgatcatagacttcgcccctttcatgaataaaataagcctttaaaacagatccatttgagttggattaagtccatccggcttgatatttaatattttttgcagtgctaatgcattttcagccgcatccccaccagaattgttattaaaaatcacacctatctcttttgtcttagaatcaactgctttgacttcacgtgctagttcttgcagttctttttctgaataacgatacaatgttctttttttgcgccaatctttatcatttgcttgccatccctgagcattcctaccatggaatcgaaagagagcaaagttcggattggttacaaatggatcaaaagggatcgttgtattcagcagctgcggctcatcgatgatggctaaagaaaaagcggctcgagacataaagtttctcgtacgttcaagaaattcatcgctgtaccaagaataatcccgcaattctacggcaacaggataactctcaaaccactttctaagtttgcgcaagtattggacattttcttttgtacatttgaatgaagaggggaattgaattaaaaagcaaaaaagctttccagcttctaccattggcgacatgacatctaaaaaatgcgtaatcatctcttcttcggtctgataataaggcttccaatctccttgaccgctgatcccttgatagactttgactacaaagcgaaaagattcaggtacttcgtttatccaattctcaacagaggactttcgaggaatcccataataagcagtatctaattccactaagggtagaaatccggcatattcatacagagtgttattctttttgccagttaatttgtcatgttctttaaacgatgttaatccgattctgatcattttcgaccaccttcgtaattgttttcccttgactgcttttttgtaaaagaaactcaaccaaatactccgtgcattaagaggtcaaggtcgagtcttcttcgtttaagtaagggcagcttttttataataagtctggctattgttattcttcactgatagcaaaactcttttatatagtatacaataagatttaacggctatgcaaaattattcgtaaggaagtctgtaaaatgaaaaaaatacttgtactgcacaccggcggaacgatcgccatgaaagaaaacatgctcactggcggtgttagtcctgatgtggcaaacccgttattagatgcagaaatcacgatacctgagcatgtggaactcttagttgaagatatcttcaatcttccctcaccacacatcatgccttctcacatgttggtattaaaagaacgcatcttgtccgcttatgaatcaggtatattcggagtggtgattacacatggtacggatacattagaagaaactgccttttttcttgatacaacgattggtgacaaattaccaattgttttgactggggcaatgcgttcaagtaacgaacttggaagtgacggcctctataattttgaaagtgctattcgcgtcgcaagctgtgaagaagcggtagataagggtgtattagttgtcatgaacgatgagatccattctgcacgctacgtgacaaagacccacaccacaaatgttgctactttccgaacgcctacattgggaccaatcggtttagtaactaagaatcgaatcttattcttacaagaacttttagaaacaaagcggctggatatttccgctgtaaatgggactatcccaattgttaaagcatatgctgggatgcaaggagacttattggaagcaatcgcccatacgaaagtagacggtctagtcattgaagctttaggtgccggaaatctccctcctcaagccctagcagctttagaaaagctccttgtccaaaaaatccctgtagtacttgtttctcgttgtttcaatggaatcgcagagcctgtttatgattatgaaggcggaggaaaagaactagaagaaatggggattattttctgcaacagtatcaatagtcaaaaagcacgtttaaaactattgattgccgtaaactatggtttgacgggtgaagaattgatttcgtttatccaaaactaaacatcaatatctgatagctaaacttaaaaacatactaagattagaggggaacatcattgacgaatgatgttctcctctatttcccaatatataaatatatgctttctttactctttctctgctttttaatttttccgcacttcttgcgtttatagcataaaacgcaagtaagttagagcataggtatgtaaatgaagggataaaaacatctaatatatttgatgctttcattacagttaaacataaagaaactgcagaaataatagtaaatatatttttatagttttttatagatacttcatctacttgtttagcttccaaataataccatcctttgcctacacacactttacatagttaaatatatatctaaataatgaattttactcgcattattagaattttttaataataaattatagaaatttatacattacagagaacaatttgatataactatataaaaacagtctatgtacttcccctcaaaattgaggggatattttttatcgttgcggaatatttaaataccaacgtttgtcatggaaatcttgcgctccacctttagtatttccctctggatcattcgttgcacgcatcattacatagactttcttattaggaaaattacgcatattgaaagatacatgataaccaacgtttccagaagtattataagcttgatttacatctggtctataaattccatcagctcttactcgagctaattctttgccagtattgtaatccataatgaaaatatactcgtatttatagttagcaatgtgccatcctgctacatgcaagtttgcgttttcaatttctccgaactgatcaatgtgggcgtaatttgttccatctgtcagtgtaggatttgcagcacctgctctagttggatcaatgactggtttatcatctgaagtagttggattttcatcggtaaatccatgagctaaatcataggctaatttttctttacttacgcccatttcagaaagataaccgtaaggatctgtatgatcgccccaaatattttgtgttacccatagatgcgatttgattcctggttggttataaggagtatccaatgttaatggaataccatatttcattgctgaatctcttgccaattcaacatatgctttatagttcttttcaaaaattgctttatcatgtgtgtgttgtaactcaatctgaacaggactattggcattagcatatgaaccagcgccatactgcacataaccaggttgtccgacttgataaacaattccaccgtctcccacaatgtaagcagtgtaagcactagtccatgaacgttgcatatactgtgcttcattgcgtcctgttgctgtttcattagccgtttcatgcagtaaaatatactgattattcgctacttgtgagctaccttcgtttgggcccaaattaaattcattgttaatcgtataggcgaacccattaattggcaataaaaaaagagccgttaataggctcatcgcagtaatactaattttcttcttcatttgtttcctcctatttttttaaattataagccgacacaccagtgataacgcctaaaaatgttgctactgcattgatagtaagtactgtcatatctgttccattccatccataggctttacctaacgttgctactaacacagaagcagctggcaatactgttaaaaccgtccatttaatgacttgataatacttatctggtaaaatcatttcttcttaactcctttcttttttacctagatttttctctaaataaagttttaatttgttgcgtgtgttccaccaatttttctgcatgtgtatctaatctttcgtcatgtttcttcaattcttcatgaatagtaatgcgatcagatttgcttgcttctaaatctttagtcagtaaatctaaatttcggcttacttttgaaagagtctcagtaatcttcgagaaagatgcagtaattggttttattactaataaaatcaaagaaacgatagcagttattgatcctgctatcgctccccattcccctaaattaatcatgtgacaactccttaaataaaaaagcgcactcgtttgagtacgctttgcattttattttaatgtgttttcagatacatcgtatattttctcagctatcctttgcattccttcgtcatttggatgccaattgtcacttaagcctttaaatgtttgtacaccttctggccctttggtagaactgtctttccaaatatttgaaatgtcagctactggtaaatcatattttttacccgcttctttgatagctttatcaaacggaatagctttgtctccctgattccaagtcgtaactaaaataatttttggtttcttatttccaatggtcgacaccgtttgaatcatcgtatctaagttcgctttaaatgtttcgatgtcagaaccatttgctggatctgcatcattagtcccaaattcaatcgtaattaaatcgggattttgagattttatttcttctagaccgttgattccatttatactagtcccaccataaccggctactccctgtacatctacttgataacctaacttatcctctagcatttttgcatatacttctacaaatcgcttatccgatgaagttgcaaagtatccttctgtaagagaatctcccatcggagaatatacaattttaccacgatcttgttttagattatccgttccattagttgacgttagcgttttgtttttaccaactttagcttctaaattattttgttctacttttgttttaataaacccagctgaaataattaaaaagctaattaaagcaaccacgacaactgccatatatcccgttttcttcttcatattacacctcgtaaaagtcttataaaaataatatatcatacgtgtaaatattctgctatgagtattttgtgttatttttacttactaatacgtatttccctaccgcagccatccaagcccattgagtaatcaagccagttccaaatgaaactgttttggataaatcatctggaaccacaaattgtgtttcatcaaaaccaccaaaattaaatgtgccagaagatgaacgcactaaaacagtgataacagcagtagaacgttccggtgataatatttttattttgttcgtcattgtaccggaaccataaatatcaatgaaattataatttgaaatatctaaattagaagcattttgataatttagatttaagaatctagtcataggcattccacgagaaatttcaaagtatacgccatcttggtatttaaaacgaatcgagctacctcgaccagctattgaaggccctaataaaaataccgtagaagaacctttaatagttgtgttgtcatcccataaattaatttcgtaagtctcgccgtctttaccatctttgaaatcagcaattatcattttttcagaattattagttcgaaaatatcttccgaatttaagcgagggaactgattccttttctaattcttgtaaatcaaatagttgccctgctttcccaccagtcacagagctaactgcgacgtcaacattatttgcatctcttcggagagtcatattctgtgataagctaatgccagaaatatttagattgattgtttgatacgctctagctggacttgctgatcccgtttcattgaaattaacaattgtagtgtcagctaccggaaaactggtatatttacctcccccagtatctccaactgcatcacctaaacttagcggaactgtacagtctattgcagaacaatttgaaaattgattcccgacacagcttaagtcaccaacgttactaaaatagtcacgtttatattgactgaagcctacaccacattctattgctcgacaatctgaaattttattgttgattgcttctccttttctatcagacgcaggtatattgtcagctattgctccgaatccccagctagaatgtttgttagcttgacagttaataaaattagtattttgagcttttgatataaaaccatgtattccatcatgtgtctggcaatttgatactgtagtatctttaactagtccagtatatgattcaattaaaaaaccgtggtcacgtgctattgtgatacagttatctatggtaatattactaatttcttctcgaatatcaaaaccgtttggtttgtttttgtttatgacaccaacgtttttcacagtcgaaccacttgatcccgctctgaaatagacaccaccgccagtaaatacagttccatcaactaaatctccattttcatatttaggtttgatgccttctatatgaatttgttttctgaaagggaaattatttgaaagcacatatttgccagcaggaaaaaacaattttgaaccactgggcaaagtagatgctatttccgttaatttatcataattatccgtgatgccatcatttttcaaaccaagagtcaaaacattaataccacgctgatctagatttttgttggtttcatttaattttgtaagcaatgctccattaggatcgatgttttctagtacatctttagaatcttgcacgaacttattccagttgtcccattgactattcatcttatcagcaaactcatcgattttttcatttgcagcgttcactacaaaatttacattttctaatgcttcattcaatgcgtcggctgctttttgtttaactgcatcgagtagttgttggaagtctgtaatgaagtagtctgctttatcttgtgccaatccatcaatcttagaacgttgcatacggaacgtgaaacctaagttatcgctcgttgatccgtctgaatattcgatatacacataagtttccaccatgccgttataagctttcatggcttctggcaagatgtacacgacatgtccatttagaaaactttcagtgataagatttttcgtgataaacggaattggctctttggtcactgttccgtctatttcgtcatagataaacattaataagcgtaagttagcgcctaacaagtctgcgggtgtgccgtcttgtttttccacattaaattctagtgccacttggttatcatatgatttgaatactaatccagttgctttcaaatcaaaatctttcggttgcgtaggcacttttattgtcccacttttaatgatttgcaccattatttcacaccctctattctaacgatttggatttctgcatttgtgcttttgtggtagttcatattttcagtgattgctacttgagcagaacgaacaatttcatagcgtgtatctgtcacgcgttctagtttcaactcatacaattctaacccgccagcatcgtcatataagttgctgaacataataactgggccttccacgttatttgcttcgtacacttgcccaccccacccttgaatgtgaatgcgcatggaactatagtgtttcatgctatcttttaagtctattgttgtacctacgccgtgcttttcgcctttgaatagctcaaaagttgttacaactttacggaaacctgggctattatatccgttatcatcgttatgcgtgcgcgcgatgtagatgtttccgccgtaaccgtccgaagcccaaagcagtttccgtttattgtgttcttgcataacacctagtaacatgatcgaaccatcggcaaacatcgttatctgcccgtttttgtaccattggttagtggtggcataaaagcccggtggaacgtcgtacacgttagtatacttccagcctagctcattatccttcaaagcaataccacgcgcgttcattgcgatttcaggcgtacaaaaaccggcatttaacggtgtagcgtccacgtgtgcttgctgtggtgtgccgtcgaaatgaatttctaattgttgtaaaatccatttgacagattcttgcaatttttcaacttctttttccactgattatacctcctaatacgtgaaattgcggttagtgtagtggcccacaccttgtactttgatcgtacgttttgccgtatcaatttgtatgtttgcgaaccccgtttcattcgctgtgttgtactgttcttcggaaggaaaggcgtttgtgcaaacgatgatttgtgttgtgcctaaattttttactgtttcgtagtgccaatgtccggcgaagattgccgcaactgttccgcgtccttttgttgcgaagttgtaagtcttttgtcccataggactcgggttgtaaccgttcattgtattgtaatcaatagttacgcttgctccttgtttgaagccgtctagtaaggttcctagtttcgtcacgtttgctacgtcgttttctctttccataggtacatgtcctacaattacaacgtgatagcttctatcaagttgttctaaccattgtccaaaggcatgcaattggttttgccctagttttccatgaggaaactcagcaccgttgtaatatccagaaaactcgatgaattttccttgtgagttcgtatgatcttcgaagtcatcggtatcgatacggtaaatcgcaacttttttgttagggaacaaattagggccgtaacggctatcatatgctacggcaatatccgatcctgtcaacgaatcgagccgtgaacgtccgtcgtttgcgtatgggattttacctgtttcgtggttaccacggcaaagaatgatcggaacttctgcgcctgctgtcgctacgctagcaaagcgtttcaacacgtgtaagttcttcgcgcgtctttcttgttcggtataaggataaatacccgacgctgttcctccactgtatccgtcgatattatccccgccgtacaccatcgcgtccgcaaaggtttctagcgtcctgaattgtccgacaatgctccaacgacgttctgttttgtctttctggtcgaagtgatctaagaattgctcgtgtgaatcgacatggatatccgtcatgaatcccatgttaaacttagttttatccgcttgcgcgatcactgtgtctaaattagtagggcgaacgtagttatacgctcctctgtcgtagaaaagtttgtctcttttgattggcacttgttctgcacctttaggaacattgaatgttttattttgaatatcgtctaagcgagcggctaaactgtcataatctccttttgcttcattcaaaatgttaatgatcgtaccacctggatcgatattttccagtatttcacgattatcttctaaccactgctcccagtcactctttccttgattcatataatctttgaattttcttagtaaattttcaaaagtccaaacataaccagaatcacgtaatcgacttcttgatattccagaaatgactcgataattaaaatcttgcgtgctaaattgttcactccaagttccgtcaccattgagtgatcggaagctgaaatgggcggtgttttcaccaccccattgccagtcaggctcgcttaacgtgtaaacaagccttgcctgtgctggactgtattcctgtactttttgttcaacaggttggttttcaccaaattttgttgtattaataaaaaatggcactaggccatcgaatgtttttagtttgccatgttccaccacttcaacaacgaacttttgagttaaaacatctccttgccgaatccgaaccaaatttattccgttatttggttctgtggtggataggaccattttatgttgcgtttctgccacgactatccctcctttagaaattgatatagtctcttgcattgtggaaatgacctgaagaagatggataaaattcatccataaattggaaatgaagatgttctccagtggatggtcctgttgtccccattagtccaatttgctgacctgcagttactttttgaccttttgaaacatccacacggctttggtgagcatagcctgtatacattccatcagcgtgtttaatcactgtccaatttccataccagtcaaagtaatttgcatcacctgcaacaatcacttcgccatctgctgatgcaaaaataggtgtattagggtttccatttacaagatcaataccgttatgaaactcttgtgcttctgtgattggagaagtgcgccagccaaattcgctcgtcactttgattggatctgcaattggttttatatatccttttgatgcaggaatttccaaatctttaaacttgtcataccattcttgtgcccatgtcgtccgttctggatgtggatcacgtggacgttcaaagttagccacgaatgcttgtgttgctgtgttgatatcggtcagattcatgaattgtgtccatgtataaggataagcgctagttgcgatccattgaccatttggtgcatgccacatcaacaatttgaactgcgccgtgatcgtgtctggatcatcactgatgccagcctttgtcattaagttgagcatatagacacgtccgctagttgcacctgtggaatccgtccattgccatacaccatatccgaatcctggtgcgccattgccctcatcggcggttggattagcatctgattctccttgtgcattgccaagtaaagctgcagtagcttgtttagtaaagccagcacctattgccattgcccaaatctgccaataacgtttatcccgatcagtagttacttctggtggatattgtccattccaaccgttatcgtttcctccagtattgtctcctccattattgtctccaccgtttgtatcgattttaacgccgttcacatataattctttgacatctagacggccatctatggttatatttccttctgaaaatttaccatcaccgtaaagattatatttgcgcttatcagcagtaacgtctgctggaatttgaaaaacaggattccctcgatcgccgccgtccccagcgttaatggaaaaaatatagtttggttctttccatacagcaaacccatttatttttccgcctccataagttgctacgatggatccaagcgattctccgtgaacatcgtcaagcccagttgaaatgacctttttttcaaaagaaagttgtcctccttctgccactaattggaaatctttatcatccaatgtctttaaagctaccccttgcacgagaatacctgaaagaattcctgctttaataaaattagcattgaaagttccatccaacgtccacgcagtcgtgctatcgccattgtgtacatcttggattgtttgccattcaccttttttacactgtttgaaagatattcctgagttattttggaccataaaaaagcgtgatctagaaatgttaggtccatccatataaacagtttcatagatttctctactatcactaacaccagcttcaattccatttacccaataaatagaaccgccattatctcctgcgcctcgcataatgtcatcttgatattttccaatctctgtcgattcgtaaaatgtcattttgctagattctaaactattaatattattgacaatagaagccgtttgttttctaacgtcttgtgttaaattatcccctagttcgatatgggtttgaccggtaagccgattgaatgtagttttataaatacgagttttatagtgataacctttatcgtatctgtgaatagtcactgtatttcctatcacatctcctccagtgacttcggctttgaattgtactaacggtctagcagaatcgattaaggttgaataagtatttttaagtaattctgttggatcatctatatcatcaaacactaccacggtttctcgctttctcattgagccatttttttgtggtatcccatacttttgagttgcttccggatcttcaagccaattttggcctttaggcttatctaaaggatcaccattcgactttttccattcaacatcagtgaattcaattcttctaccgtatccgtcgccgacctcttcgcctcgcccgcgacctatcattgaagttgagattgagcttcgatctatctctcttacaactgttaatgctttactaccatatacaaaacgtgtattcgattcttcaccaatttgttcatatacttcgatccatttatcctttattccatcagaattcaaagaacacctaaagacaaattccatacctaaggtttgcaattctttcaacgcttcttttacagagacatagtaaaaagttgcagttactgctggtaacattgcttctacgtgaccaacgcgccaatttccttcagtaaattcaatcaatcgatcaaggacattttttaagggctgcccactcggtctaatatctttgatgatgtaagcatctaattcatttgttgcaaatcctaaccctgtaaactctaatgtttcagatgggtcgctaactttagtaattcgatacaacgaaaaagacgactcgttttcacgaatcgccatatatcttgcatcctctatttctttatcatattttgtcgtaacgtatagagtatctttcattagatcgctcttatcagaactaatttctttttcttgggagacttcaatcaaacttcttgtatttttccttttaataagtttttgcaagtgatcaaagaaataaactgtctcactcaaattgtcgcccccctatagaatattttaagcttcccattattgctagttatcttctgaccttgcttaagataaaagttctcaaaatcactttctaaatcaatcatagaagtacaatcttctccgtttacagttacctgctcatcggaaaaatcaaaaaccaacacgtctcctgtttttattgccgcatcagttatcgtgatattttgttctccgtttgtaattttgattgaattattcatggataaagtaacttcaatttttcttggtgttataggaaactgtatcggatttccaatatagccatcactaacacattctttcgtatactttagtggatccgcacagaatacattaaaactcgaaataatcgagttggagtctcctggaacagtatcagttgatgtatagcgaccgtagtaataataatctaattcatcatgaaacctaatttccacgtcttcattccggtataaataattcaacagttctttgaatttaaactgtagtttttctggatctctatcttccagtttatatgttatttttagtgttcttgaaggtattttctgatttgtaatgattgaaccaatttgtatctcttgctgttcaacttctatagaaagcatttctctaccttccaccgtaagtgtttgataaccctcaatcaaatcttctaaatacattccatcgtacatcatggcagacgttggaaggaatcttttagaactattgagattaatagttgtatctttgaatgagtacattttattttctcgctgatccaaaatattccctcctaaaattctagattaatgtctgcaccttcgcccacagcttgtgaaatatcgtccacaaacaatctaaacgattgtcttccaagattgaatttaaatacagctggtttagtagagccacccatatttattttatgttcaacttgtgcaccaatgtttttatttgcatttttcaaatttgcagctatatctacatcagaatttgcattgaaaagttccgcgataaagtctgccatacttccaacagtattctgtacatcattgaatcctcctgtcagtcctttattcagaccgttcataatagcctgaccagctggaatcaatagctttctatcgtattggataggtcctttatgttcacgaatccaatcaccaatacctccaacaaaatcttgcacagatttccatgcattttgtaacccttctagaaaactatccatgatggcttttccggctgctaataagtcgatatttttcaagttatcaaaccagccagttactctatccaccgtatcactaacagcatttactaaattatcccacacttcttgagcgccacttactaaattgttgaaagtatctatagtaccttgttttaggttttcccatccctgaatgatgttatccttagttccaataactagattaataaaccaagctttgaaagaattccataaatctttcgctccttgaatcatattattaaacagatcgattgtcccttgttttaggttattccatccctgtttaacactatttacaatattgttagttgtctctttgatccatgtagtaaaagaattccacacatctttgatggtagaagtcaacacattccagatatttatcacagtatcctttaaggctgtgtaataaccaacaactatatctacaaacgttgtgataatgttttggatatttgtagttaatgtagtccacagcatcgatgcatcttcttttaactgattaaaattgcctgttatcaaatcaatcaaaagtagaattggacccattacagcagtttttataatttcccatgcagaacctgcgattgatccaatttgagaccataggttcgtaaagaaatcaatcattggctgaaaaacattttttatggcaataacatacggtgctagaatgtttacaattccttcccaagcggaactggcagcttctttgatgccatcccatatactcgaaaagaactcttttgtttcagtccatttattcttgatccaatctgccgctttcccaggagcttcttgaattgtagtccaaacattgtctgcaccttctttaatggacttccataaattgttaaaccattctcctgtagatttccatgcattctgaatccattctactgccgagcttacagcagacttgattccctcccataagccaatccaaaagtttctaaaatcttcactcgtattccaaagatagatgaaacctacaacaagtagtgctaccgcagctataaccaatccgactggactggtaagaaaacctatggcggaacctaatttcttgaacaaagagattccgttacctaatacacctaaccccactttcatggtttgaaacgctttaaccagcattcctaatgcatacaatactggcccaattgcaatagcgattgctcctatggccactactaatctttgagttgattctggagcacttacaaatttttctactaagccggatatggcatctgctacttttttgatggatggtgctagaatcttttgaattacaatagctgctgactcaaaagctccaaacatttgctcgatggaagaattcatattatcttgcatggtccgagccatatcgtcagctgcaccatcagaatctttcagagattttgttaatttgcccaatgaatcaggtcctttatcaatcaaagccatcatccctgataatgattcttgcccatatagtgttactaaagcattttgttgttgttcaggcgtcaggccttcaaaagcttttttaagtaattctacttgagtttttaaaggtttcattttaccgtcagcatcataaaacgaaacacctaaattatccattgtatcttgcatagcctttgttggccttgctaacctagacaatgctcctcgcaacgttgtacctgcttgagaacccttaatacctgcgtcactcataataccaatagctgctgcagtttcttccaaagaaatacccattgaattggctacaggagcaacatacttcaatgcctctcccatgtctccaacttcagcattggtatccgcagcagcacgagcaaatacatcagcgacatgtcctgcttcacttgcttctaaaccaaatcctctcaaagcagtagcagtattttcagaagctagagccacatcccctccagatacagctgctaagtctaaaagacccggcattgctttcatgatttcttgtgcgctaaatccagcagaagcaagattttccatgccggcagccgattcttttgcgctaaaagcagtttttgctcctagatcaatcgcttgctgtttcatctgttcaaatgtgtcgcctgttgctcctgatatagcttttacacgactcatttgttcttcgaagtcgccaccaactttagcagctgctacgcctactcctataagaggagtggtaatatactttgtcatttcggcaccagtaccttgcatcactttacctacagcggttgtcatactatttgatttcttttcaaaagtcttaacagcatcttgcgcatctttaaaagtctttacaaatccactatctgtggcttttaataaggcttcaacagaaaattgttccatgattttcctcctttcctcaagagttagctttagttagtaagctttggaattttttatcttgttttgaaagttcggaaactcccatgattgaatcttcaattttttgataattgaagaattcttcaaaggatcgatatacaggaactgtctttttgcctacttttttctccgcttggacttgctgatttgcccacgctaattcgtgaatcaacttttctttgtcaagccaagataactgggctgcagtcatacgaatgttgtattcatataacgtcattctttcgatatctgagatattggtcattcccaaatatcgaaaagaattgataagaatttgttcgtatgccagtgcagaatctattccgcttgttgtttttccgcttctttcaatttctgattcaggtttcggaccgctaactttcccgcgttcgactccgccaattcttttaggacttcatcaaacaatttttcgatgtctttaacttcatcgatgtaatcatccatttcatccaacgtaatagtttcttcttctgttctatttgctatttctaagactcgtgacaacgtgttgacattataagaacgtaattccggtaagacttttgctgagagtcccattccgaattccatatttccatcgatgaaaggcatcactttgtctaattcacgtacaaatttagtgccaaatttaaacgaatattctttacctttaatttttaatttcaatgtttttcatcctcctaaaataaaaaagagagcatctaagccctcttatgctcctgtcgaagttgctttcacggtatctttgaatgcatattgaacaacatcggcttgatcttctgtcaaggttgcataaccatcttgaccaacaccatttactgcaaatgataaacttaattcaacgttatcctctgcagcagctgatggagtaaattcagacacatatgcttggtaataagtagctttgtacttatttgcatcatcatctgtgccctgttctgctttgttgatttcccaaatttcaatgatatcgccatttaataaggcttgtttcatttcatctacatgagaatcgcctttagcaactattgaagtagccgaaaaatcatattcaaccgggcttaaactttgaacgtttccgtcttttgtcactgtagagtctgaatctcttgataatccattttcatgttctgtttgaaatgccattttccaagcagcttcctgagtttcttttttcaataagcgataaagcaaaatgacatcaataccttttaatgcttccatgttcttcctcctatctaattctaaattcaagtgtgacaaccgctcgttttaggggcgtattggttgttgtgtcgtccatcacttgaattccacttgcttgataatttaaagcccaataatagccttctgtggcttctatcaatctagcttcattaaaaagagcagatgccatatctgacacctgctttcgtttcttctgtaatccccagacggataaaactacaatcacagtacctttaatatcagttttattcgcttcgtgaatcgtttgagtgttctcaaattccacaaaaggataaccaacattatctaaaggcttgtaatcatatgttttgtatcctagtttttcttgggatattttaaaaagttcatcaaaaattgattgatctcttgtcttaatcatcatttcaccaaggctttcatttcagccataaatttgactttttggtaattaaacgctggtctaacataaggctgtgccgacataaatcgagtgccatattctacataaggtgcataatctgctgtcggtcctacaatcccagttaagccagcttctgacaaggtcatgcttattgatcttcgtaagtaacctgtatccactggcgcacctttttgcattcgttcagtcatttcagcagtattacttttcacgactttttgaacgtcattaagcgttgctgcttttttcagatgtcgcatcagctgatcgattcccttgaactcaagatgtgctttcatcaacaatcacctcctggacgataaaagtgtttttaagtcgaaggttacgctcagtgataatctcgaacttctccgttttgctctttagtttgttgaatattaaaacgtaatcccactccttggtatagggtcgaagtaaacgaataacttttgcaccttgcttaatatctccgaacaaaactttcgagcgatcagttcccaaatcagttatattagcaagcttgattttttcgtctaaggtcggttctacatgctcccctaactctggatcataatagccatctttttcgataacgaaagttacttctgtgtcatatctcatataaaagtcgccacacttctataaggaggggtatccccgttttgcttctttagatatgcaaaaatatcctcttcaaaatcatctaaaagctttccataggagattgattctccctcttgcccatacgagttcataccttcgttacccttgcggttgaatctcttgatcgtacattcgactacgatatagtttaacgccgcaggaacgctctctaagaagcctaaacgcacacatagttggcttgagattcgtttgataaagtcagttagctgtttatcgagttcttcgttatcaacttcgagcgatcgtttcacttcttctaaggtttcgtccatgactgcctcctttcaaaaataaaaaggctagtcaaatgactaacctttctttttagttgatttagttggtttcttaacttgtttttcctcgatcttaatcggttctaagaatcctccaccaaacgcttcaagatttttctcaatttcatcaaagcgctctttgttcaaatcaatctcttgaccaactttataagtttctttcgtgtgaacatcaatgaaaactttagctactttatatttggtcatagaggatcacctacccttctgctaatacagttgcttggaacacgttgtccgcttcggggaagctaggaagtgcagtaccagctgcttttgtccatgttccaacagggtcaagatttgattcataaaccattgcaaaaatgtttccaacttgataatcattagtaccaccagataatagccgagattcttctggcgttacaccgaaaatagattcgcccggattttcatcaccgaacatgacaagtttattttctgggaagtagcgctctttgaccaacacgccttgagcattttctttatagtacttagcatcgtacgttgcgattactggcaaaccaaattgttgtaacaactgatttaatgttccagctgttggcagcaatccagcatctttgaagtaagctttgataccagcattttgcaaaatagcattacgaactttagtcgaagttaagatccgagttggtgtggtatctagcgtacctgcccatgtagttaataatccgataacatcggtagaagaagcagcgaaatcaacggtagctttgtgttctgacggaacaccgtaatcaacaactaagtccaatccgttttcatctaatgttacggttccgtttgccaatacttccatgcgcattttttcaacacgcgcattaacagaagaaaccattgaaaatacatcattatatacttcattttccaagaaagcctgttcttcagcagtacgaggattgcgcaatgcaatcaagtctttttccttcaactgaattttgcgtttgatgaaagctaattcctgagcgctgcgagaagctacacgagatgcaatttctgcctcagtatcaaatgcatgtacgcttgcgatcgttggaatacgagtacctgcttttaaaatatcaaattcaagcccttgcacctttcgtgctggaaaaagtgtttcacccaacaaatggggagcttgacgattgtttacatagtctaagacattacgttgtgaaaataattctgcgatatttgccatttattttttcctcctatattcctattacagtccgcttgctgcggctggtagtgcaatcattttcccagatgcatcatatagtttgatttctcgcattgctgtttgagctgcatcgcttggcttaacaggtaatcgttcaattagaatgtgtccatcgacaataacgcttactggttgagcgccgttactaacatcaacatcattaattgtgataccttcagctgtcccatcgtttgctgggtaaactgaccccgctggcaatacaccatttacaacacctgcgtgagtgttatctacttgttttgtgaatgaaatgaattgttgagattttagaaaattgatttctttgaatgtttctgattttttaacataaaccattgatattcctcctatttaattgcccaagggtcattctcaggctttttcgtttggttgtttgcattttttgctagctgtgcaccacgagaaattgttgtgccatttccatctaaaggaattttaccaccaaggcgcttttcatattccgctttgattgcttcgcgttctgcttcaacagaagctaggtacgttttaacgttgtttgacgtggtttcagcgtcttctgacacaattagtcgaagcatttctttcgtaggcttagcgcctttctcagacagcatttcgcttgcttgttcagacatcttggatagcacttctttacgttcgaactcagctagttttgcttcaagttgctgtttctcgtaatctgctttctctttatcgtccatttcggcaagtttggcagcttcgtctttttcttgttgttgtttggcttcccatttagcaaactttgctgcaataatcttgtcgacatcagcgtcactatattttttgtccgcatctgtcggatctgaaccgtttttttctttgttatctgcgctgttacctgatgtattatccggagtaacatcagctgcatcgtcttcggcaaagaattgcaagttcattggtaataattttttgactttcatatttgtttctccttccatatcttttaacgtggataaatgcttgcactttccatagcttttaaagtcatcaatgcttggacaaaaacaaaaagcctaacgtttgctagactttaatacacttattttcccattttttatatgcatcaaggtatacttcagatttatcaccgttataggtcaattcataatacataccatctgaaaccgttgtgctgagcaaagctttattgttttgcaatgttttgcagctccaaacaacaaatacatcttcttcggtaatttgaacctgatctgtcttctcgaaattctcattagcataagcaataacagcttctttacagatatcaatgaacttcttactatccatgattattcctccacggttacgccgctacccgataatttaactagttacgccagtcagtcggaacagctttctctttagtgcctgtaagcagtaagaaggcataataaaaagccgttagcgaatgggctagcgacttaattacaaataataaacgctgggttcttcttgatcttcatataatctcaatccatcatgaataccgtcattttgaagctctttgtctagtatttcatctggaagtttattgagaaactctttaagttccttaagtgatttgaattctatatcaatatcaatttttggttccaacttgtgttcctcctcaactcgtttcaatgtctttgttctagtggctaaaccattaaatatagttgacaatatttttttattctatatactatctgccaaaggagggatagcaatgaatgaaaaagtgattgaactgttgacttcaatgaacgaaaagcttgatttgattgtaaacagtcttagtgagatcgaaggcgactctgaattaacaagaatcagcgctgaaagcaccgttgaaaccttggaattaattcaagagaacgttcttgcgattaaacatttaacaactgatccagacagtcatattgaataaagcactaaaaagaagccgttagttctaagctatcggcttttgtattttctatttggtttgtatgttttttcaggctccttaaattgatatgtttcttgaatgttgtctagtccgtcaatgattccatagaatttcatagtgattgctgatacattatcaacgcttgattcgatattaatatctgttaaaccgtcaacccgtgtaccatcaatgaataaaccgttgctgattgatactttgtttagtttcggcatggttataaccccctttctttaagcgacttctcaaatgcatcacgatcaactatcggataagtggaacatctatcaaaaggatgtaccggcatcatatttttgccaacttccatttcacttactaaatatggaccatcagcggcaatgcttttacataattggcaagcgttaggctcagttacccatccatatttctcgatatccgcatctagataactttccttttgtacaccgctttgaactcttgttgtttcggttaccatcaaacgttgtgtattaaacttagtattctctcgtccttcttctgttagaaacttactcaattctggagccagctgtttagggtttctacccatcgtcacactacgtacaagcaacttatctaaatcagctttcaactctgcttggtacatccatagtcgttcgctaaacgttgcaaatccatctgctcgaaacgagctgtttatcacttgctccactagtttggcataaccgcttttagcgatcgtcatttctaggatgcctgcttgacgttgcagttctttcaaaccagcgctggtaagctctcccgagaagtatttatccatatcattaaaagtggctatcagctcaagtccaatatttgctttaagcaattccaagcggttaacacgcatcgttaggttgtatagtttcaactccttgtttgctgtaggtgagaagtctttctctttaacatacttcttagccttgcgagcaaatgcttttacatccatttcatcagcacgcttcattgcttcgctacgagtgattttctgcccgttggaaaaactatcccactgtgcgtctatctctttctgtatcgcatcctgtgcgtattgcagacgcttcttgatctcgttcatgcgtttcttgtcatctttaatctgttgctcttgccaagctttctcccgcttgatgaagtaatcttgtgatttcacttaatcactcctcgatgatttcgtaggtctcaagaaagatatctggtttgcacggataaaattcaccatgaacgcctttgatgatgtaatcaccatcagatatttccatcgtgccttctaatgtttcaataccaggtaatccattcggcatattattatggtcaacccatgcttcaccaacgaattctttgcatttgcgatatgaacgtgcagatagcattttaagttgcacaatctcgacagtaactggttttttacgtgctttcatttcttatcctccctaccaagaaaatctgactaactcaattttcgcatcaatcgtatgcttatcctcgtaatcctcaacagtaaagccgccatcttgaaactctttgcgaatatcatctgtgataacgtctttgccgtacaggacttcgttcctgccaatcttcatagcttcagcaatagcatctttgattttttcgctatccttcttctgatactggttcatcatctgttctttgagattcatcttcttcaacctccgtatcagtttctttgtcactgtcaaacacaccagaaacggcttgtttcttcaatcgcttaagttcttcttcaaacggaacgccagttaaccgctcggccatttcgcacaacgtttgatctgatacgatgccgaccattccagcgattacgctcatgatttcttcgtcagattgcggtacgtttggcgtaaattgaatttgtatctcgtttactttgttgtatagctgctcttgttgcttttcatcagaaacaaaaaaggctttgactgtatcaatcaagcctcgtggtttatccagtccgtctttaatgctccaagagtgtgtaagcaaccgcagacggcgcataatagctttcttaaccattcgttccttgttcttacgatcgttgtctgaaccccaacctttgaaacggaatccgatgcctgactggttggacccgatgttctcgtcagtaaaatcaataagagatgtgaagcgtaagatatcagcaactgtccggctgtcgttagcttccattcctgcaacgtcatactctttcttaaggtaatacgcatcaggttctgcacctgcaacattgttgtcgtatatctttttatcgcctaatacaagcattcttgcttgcatcatagcttggaatactgctaacttgctgttgtcgccttcttggtcgtctgctgtgtcagggttccctttaatcaccaagtaggcttccgacgaatcttgttggaagttagccatttccgatcgtgaaaggtcgtatgcatcaatggaatccattacatgctcaaaatcacttgtgcgctcttcgttgttgatccattcattgatctgaacagtgtcaaaatagctttgaacttctccatcttcatccagtacggcattttccaaatcatcatctttagctgtgaagtaatagttgtatccacagtttgtgtataactcgatccgagtgaatgacttatccaaaaatttctcaacgaagtaatgtacgccgcaaatcgagtttctatcttttgtgttgtcataaatcacaaatgtttgctccgcatcaaacttagctattgtttctttgccatattcgtcacgtccaacccactcataagcacgacctaagccaaatgcatcacggctcatcaactgattatggtagtcctcattagattcgctagcaaaccgattaattcgttcaacaataaccttatcgccgttataactaatcggattacctaacaagacaccttgtttgaacgacacaataaagttagcaaaatcgctcgctatgcggttgtctgctctcccgtctggcttgtttggacgtcgcttaatgttattgtctgcattcagatatcgctttagctcttttaatctaggtacttgtctttcacgatgatgcttgataaagccaacaatcattttccacatatcttcatgcttgaagttgataaactcgctaacctctcctgtctgttgatctaacatgtcgattttcggcaactgactaactggtaccttatagacaaggttagcttcttcatcgaatcgttgttgccctagaagctgaatattctgttccactgtatcacctctacaatcctagttttttgaatgtgtcgatcgtctttttgacgttgactggttctggttgctttctcatgtcatcgttaaaagcatatcgagtagcatcgattgtgtgattatctttgtcctcaagtcgaggttttggatttccatcacgatctgtttgatagtcgatgttttcgaactctttagcgatgtttggtgttctgatcggatcgatgtatatcgcatctaaatcatctagccatttttcaccgtattcaacactatcaggtcctttagtaacttgccttatcttcgatatgtcatgctcatttctcatctcagcgtttgatttaggttcaacctctgcgatgatatcctggtagtgatacttattgctcttaatccattgagctgcacgacgattgctacatttaacctcgtatagttcatcaatggcatatatgcaattcctcttcttatcataatgccaacgcacaaaagcaagaggatctgttgcgtaaccgtagtcaagcccttggcgaatgttgtcgaagtttgccaccatttcatctgtgatacttccagcttcaattcgtagattgtcgaacggtacaataccagatccaatagctttaccatcatactcccactcagctcgtctagggttccttgctctggctgcttcgacttcgctcagaaactccttagaaataaaagggttatctttataagttgaatgatgaatgaatgtattcttaggctgaaaggatgtttcatattttttgtttacccatgattgtttccgttttggcggattataactgtaaaagaatttataaaaaagaccatcgtccaactctccacgcaataaggagttggtgatagtcgttacttcatcttcattcttaaattctgctagctcctcaatccaaccaatcgcaaaaggaaatttgctgtccttcaacgacttaattcgttctggattttgcgctccacgaaatatcatgtagttaccacgcggtttataagtaatcctcaatggagatttattaaacttgaataggtgggaaacaccttgctgttcaatcgcccatttcatctgttcatacaatgattgctcaagtgtattatcaacataacgtatacctacagcattcactgcatatctcataagtaactgagtaacgatatgcgctatatccgatgattttcctgaaccacgcccacctttacaaactatattaagaatgtcttgatttaaagttgctctccatactgaatgaaacttcggcggaagaaattcagatagttttttagccatcatcatcactacttatatcatcaatgaaagtaggtatttcagaaatttcaactttctgcttatctacaaatgctgcgtttattttataataatgctcaagtgcttggttacgttctttgaaacctgctgaatattcactcacttcacgttctatgatttcgtttgtataaggatctctcttaacaacttcaaagcgttgtggttctccttttgcaatagaagcagtaatagccaaagcttcttccattgttaaatgcctcttagtttgaacttcttttagcttctcttgaatgtagtcggatacttttccacctttttccaccaatttttcttgtgcgttcttagcgtagttttctttatagccagctttcagcgctgactgataagcattgcctgtgatgatgtactcatcagcaaaggcttgttgcttaggattcaacttactcattttccatcaccacctttgttatatgttaatgatatttttttatatttgtctgtatgttctgctcactaaaatatccatggccacagtaacgaagattgtacttatcgatctctttcggtgtagcttctctggtcatttcaatgatggagtacttctttttgatttggactgattgtacaaccctcactggatcatcattattcgggtgcgggtatttatttgttagtgatacataccagtagtttctcattagccattcttctcttcaatagcatttagatcattgtaaatagcctttgctgtctctaatccgacccgcagtcttcgttgaatgactccaacagttagctccatatcaacttcttcatagtccttctttagttgcttcatttcctcgaaatctttagtagtatattgtttcatataattattctccttttaaataaaataaaaagaccactcaaagagtgatctcatatgtaatagcaacctacacacagacaagtctaatacttcctgcacctcaccactgccacatccctcggttgctaattgacaggtgcatcagttgaggtttccagctctgatactcaattcgacaataggatatctctgtcaggtatagtccgttcgaatcgctttacattaacaactttcctgtcagcagttgctatgcaccagatatctttgtgtttttactaactggtagtttgggattaacacaaacccgaagtcactggcaatgaatcgaacattgcatggttgccgaagcattgacctagcacacatgcttagcgtctaccctttccgctacagtgacaaattaatattgtgaaaataaatactaagcgtataattttatttatcagcgagtggtccgctgaaataaattataaggagaaaaggtaatgtctaataattttagcggttttgatgatctaactagtcatctaaacaaaatgtcaaaagctgctcaagagctagatggagataatgagattcctatggctgatctgttaaccgattcttttatttccaaaaacactagttgtcaaagccttgacgaatttttcgaaaaaagtggttttgatgtaagtagcgaagaagcctttgcagctatccctgatgaagatatggatagattcgtgtcccaaaactcgaatttcaacacatggactgatatgcttggaactgccacacaggaatatgttgctaagaaacttggattttaaatttctcaatcaattctaatgtttcttctaactgattaacttggttttgtgccaacttaatcagtttttttaattcaacaagatttgatacattgaatttcattttaatttcattaaaaatggaatcgtctgcttctctatttttttgtacaactgatctgtacttttctactgaatgatcctcaattacttgttccaaatgttttttgtactctttacatacagcttctttttggatcaattctaaacgttgttgctcaataatatcaatcaaccgttcccgatccataccttgatactttatttgttcgacttccattcgttttccctccaatacataaattaacagacagcaacggatgatagataataagaataatttagaaggagttgaaattcacatccttattcttaatatttccgttgctgtctatcgaagcttaattaaacgatgagggagatttcctcccttacattttattttgtcgaagtcctgtttcctaatctttcgacactatcataatatcactggtaaaaggctaaaaaccgccatcattccgccaaaaaaccgccaaattatttataagcaattattcttccgtgtttatatgcttctgcaaactctattagagcttccgacttcatccgttgtatacttctttctgaataacccacttcacggctaattctgtagtttgagaagctatctggcacacaaaagctgtagtagagtatctgacgactaatcagactaagagccatcaaagccgctagaatcgcatctctctctgcttctatatccatcatctgaataatcgcgtcttctgccttattaccgtgcttcggtgccttcggcatatccgtaataatcggcgacttaatgtctatcaaagagcgacctgccatccgctccaaacgccgaaagttcttcagcacatctctcgcattacatcttgtctgtttgaaatctacctctcgtaacaattgcatcaagtcaaaccgctcctttatgtgatataataaatgtgttggatttattgaatcagtcggagcgatccggcttttttatttgccgagttacacttctcgacttacatagctcacaacagctgcatagtaatttgcataacctctcttagaagttgctaaagatatatgctgaatctcattgtttttcgcaaaatcgtttaattctttttctaatttatagcgagtgtcctcttcaaagattttaaatttcattgtttataacctccatatccaccaatctcgctacagctaaattctctttgcttttcgctaataacttgtcacattccatcgtgttttcaatacgaatgatcgctgagtggttatagacgtgttctacatatccacgaaatggatagatgaactcttctgcctcacatcggaccatgtcgccgactttgaattttggtttctcacgtgttttaggattctttgtcggcatatctagcattaaaccgccgataccgtggctgctggagtaaaatccgtcttttagtttcatacgtcttcctccaattccaaaccaacatattcagctttttcaaaccacttatcaaagtctggatgtctaccagtgatacgtctactatttcctaagacctggcgttttgttcgataataaacgagtccatcaagtcccatacctaaacaatatctatattgttcccctttcttccaccaaccgactttataattcattccgcttcctcctgttccttttcccaaggttcctgccgcctaattaaccaaactggtactgatttatcaccataatcctgccattcaatccaccaacaagacatcggctcattatcctcgtttcgtccaaatctataacggacaaaagcatcttcgattacgaaaggaatatcttcatcaaatccaaacaaatcttcccgccatactttaagtgcttcttctttggtgtatttttgtttgttgaatccaccccaaccacgccaatcaccgtaaaactcgctatgttcaaatttactaataccctttactggcattgatttaccccctcctatttactatcgctgacgattattgaattcgttgcttgcccaacgtctcatcatagaaaatcattccatccaagaccaacgctatgcataaagcaaaattcgttacacaatagatgtcttttatggtattcattcttaaaactcaatctttttccacattctgaacaataaagtactccttttttatctggataaccgttttcgattaaccagttcttaaattgtttgtttttttggcgcctgttcatcactcttcctcctcatcgatctctatctcgacatctctgccttctaaaatctgtttggtatcaataccttttgttttcaacgccaaaccgccatctttttgttcagcaacaatgctaattgcaattgcctttgttccgtctggtatatggagcattagatgtctgctcatctttctgcctcctcttccactgttccaccgattatttcctcagaccaactatcaaaaacagtctgaatataggctacgagtatttttcgattttggcttaaagcaatatacggatcaatcaaagcaacttctgcgtgtagacgataataagcaatacaatctatttctaaaaatctcaaacgatcaatagcatcattaatcataaaatctgtaacgttttctgctgtatttaaaccatctgcatattcaggcaggacttcattattgatgaattcagccacatcttttggacataaatcagtcagttcttgttgtgtatagttcatttgctgtcctccatgtattcgtctaatatctctctatacttttctacaaatttgaaacgaccttgatgaagtttcttgctccaatttatttgccgatccagctcacgcatctgatcgaaccctttttgaatttcgttgtaatagaattcaatgtttgctgctgctttccaatgcctgctacttcgcactcctgctcctgtttcagccatttctaacttaactaattcagctcgttcttttgattttttgtctttctgaatcttcatcatgattttcttgaggatgatatcactgtattgtgtaatgagattcattatttctcctccacatacctaaattgacgacctttagaatcaatatccatattcttcgctctatcccagatgatgtttttgctcagaccagtaatttcagataactgttcagcggtacctgtcactagaattcggtcaccatgccagattgcaatttttctcggcgttttccgtttaggcttttcagtccacattgatttaccgagcttttggacttctgcaactatttctttgtcctcctgccaattctcagaatgtgtcagttcgatgattcgtttcattgctgctttcttatccacgctcattcctccaatctacgaatttcccttcttaagttctctatgtgcaaatcgattgccttcctcgccgtttcattgaccatcactgcctttgtccgttccagatcgtcaatctcacgttgaatgcttcgaatacgcatttgaatcacttcttctgttgtcatgatggaccacctcgttaaaaacgctcttccttgaacgtattccgatattttttggctaatatcaacggcacttgatattgatgacaaaacagctttgccttgatcttaaagtcttttgtctgcattcctttaacatctacgactttgataagtttgccgtttttataaaatgtgaagtcgggaatatactcgatcttgcgatacttctttccttctagttcaaatttcggcatcagctcaaatttttcctgaagttttactttccagccgttcgcttccgcttgccacaaggctagatcgtaatactctgcttctgcgatagaatcgaacttgatacctcgatgaacagtctttttattacggtatttattcatgcgatactacctttcactggttttatgcgcttgtctgctgtttgacaatttgagtgtaccataaatgcctttttatttttctaacttaattttacaattcgcgtaatataaaaggtaaataaaaaagagtggatttctccactccatgaaaagccgactttttgggacgcttttttttgccaagcctcacatttttatagccaaacttcttttgcgacttgctgcaataattggattttcttccattgttcttcttctgttaaatggtttccttcttctgttgaagcaaacccacattgaggactgatacttagattttccaatggtacaaattgttgtacttcttttattcgttcttttattttctccgtatcttccaaatctggaaacttagaagtaactaatcctaaaacaactttactttctttgttactccaatgtcttaaaggagtaaaatctcctgctcggtcagaatcgtattccaaaaagaaaccatcataatttgttgaaaacaactcttctgcaatgggttcatatccaccggaaaacagccaagaagaagcgtgattcccgcggcagatatgtgttgtgatcgtcaaatcttctggtttgtcttccagtgcgttattgataatctctctacaaatatgggccatttctttcggatcaattcctttttgaagaagtgcttctcttttagtttgatcagctagaaacgcccaatttgtatcatcgaattgcaggtaacggcaacctttttcataaaaagcatgaatcgctgctttgtaagtagaggacaagtcctcataaaaatcagatagatcaggataaatctccttgatttttgaagaaccatcattagataggatctcttgtcgtaaaatcatcgtgggactagggatcgttgcttttgcaacaaaagtatcatctgtttccactacttctttcagaaaagcaaaatcttttaaaaatgggtgatttggattgaaagataatttatctactacccgaatattataagctggtgctgcttttccgtggaatgtttgattatatccagtttctggaacatagccttcgataccatttagttcttctaaaaaatcaagatgccaaaatccacgccgaaattcaccatctgtaattcctttgatgccgactgctttttggtcttccactaatttttttatttcctggtcttcgattgcacgaagttcttcttttgaaagtaagccttcttgaactttttttcttgcttctttgatcgattgcgggcgtaagaaacttccgacatgatctactgtaaatggtctatttttgctcatttcactcactcttttctttgttttttgtaaaaaaaaatccttttactagcaaatactagtaaaaggacgattatactcgtggtaccaccttttttcagaaaaaacattctttctctcagcctgacaataaaatcagtggtcttggtaacgaaagactgttcgtttttgcctacctttcgacaaaaaatcctctaaggccattttcgacagtcaacttctagctttttacaccaaccaaagcctctcttgaaccattttctgtctactttccttctcatcggatactattagaataaaattagaatagcatgtttgaaagaaaagtcaatagggaataagaacaaacaaaaactaatttgttattcttagtaatttgtttgtggaatacaataaagcttttctaatatgataattattcagtcgtcctttcatcttagatcacttccttaaaatgatcatacccgtttcaaccacataaaaaaggacttaattttgaaaaattccccatcaaaactaagtcctttttattatagttatgcaaatttgcttattttctcgctatttccgatacatcttgaattctaagaataggtcattatagatgcctaggtatttcgatcctagatcttcgtagacttcaagatgggagatcgtgtcatcagatggatagaattgttcgtccgacgaaatgtcttttggcaataacgcttttgctttttcatttggtgtagaataaccaatatactctgcattttgtgccgcattttccggttctagcataaagttgatgaaatcataggcaccttctttatttttcacggtttttggcataacgatattatcaaaccaaagattggaaccttctggtgggatcacataatgtaaatgttcattttcccacatcatatcggcagcttcgccagaaaatgtcactgccacggaggcttcttcattgatcatatacattttgatctcatctgccacgattgctttgacatttggcgttaaatgattcaatttatttgctgcttctgtcagctgtgccatattcttactattcaaagaatagcctaaactattcaaagaaagccccataacttctcgtgcaccgtcaatcagcatcaaactgtcttttaattccggcttccacaaatcatcccaatgcttaatttgatctgcatcaaagaatttatcgttatatacgatccctaaagttccccaaaaatatggaatcgaatactgattatctggatcaaaatccaagtctaaaaatcgtggatcaatattatttaatcctttgatcttcgaatgatctaatggaagtactagtttttctttgatcattttttggatcatatattcacttggtatagcgatgtcgtagtttgtcccaccttgctggatttttgtgaacatcgcttcattagaatcaaatgtttcataattcactttgtatccatattctttttcaaatttcgtgatcaaactaggatcgatataatctccccagttatagatggtaagtacctttgctccactcatgccacttgttttttcaagttgacgaacaccaagcagcagcaccgcaataatgatgagaatacctaaaaacagagattgtaattttttcatcgcagccgtgccaccccctcgcgtactcttctgtttttcttcagccgttttggacggttttctttactaatgaagtagtatccaatgaccaatatcatggagaacaagaaaactaacgcacttagcgcattgatttctaaactgattccttgtcttgcacgagaataaatctctactgagagcgtcgtaaagccatttcctgtgacgaaaaacgtaaccgcaaaatcatcaagagaataggtaaatgccataaaatatccagctatgattcctggagaaagataaggcaaaatgatatttttgactacttggaaattattagcaccaaggtctctagccgcatcgaccattgaatcgttcatttcctgcaattttggcaagaccatcaagacgacgattggaatgctgaaagcaatatgggaaagcaatacactctgaaaacctaatccgaatcctagtagtgtaaagaaaatcaagaaactagcaccgataataacatcaggagagactaataagatgttattcatgctcaacaacgctgtccgtgcacgtcgttttttcgtataatagatccccatagccccaaatgtcccgatgatcgtggcgatcaatgcagataagaaagccagcatgaacgtattcaatacgataatgatcaaacgtgtatcttcaaaaacagcttcataattttcccaagtaaatcctgtaaagctgttcatcgttcctccttcattgaaggaataaaaaatcagatagaagatcggtgcatataagaataaaaaaacgatccctaaataaagatacgaccatttaaattttttcatttatgagcgacctccttttttcttctcgcctgtcaggagcatcacgataaacatagcaatgattaaaatcacaccgattgtagaacccatcccccagttttgtgtaaccaagaaatgctgttcgatagccgttcctaaagtgatcacccgatttccgccaatcagacgagtcagcatgaataaagaaagagaaggaataaatactgcttgaacaccacttttcacaccatttaatgataacggaaaaatcactcgtcggaaggtctcaaagctattcgcgcctaaatctctgctagcactgatcaaagaaggattcatctcttccaatgcattgaaaattggcataatcatgaatggaatctcgatatacgttgccacgaacagaaaactgaagtctgtgaataatatctgtttcggcccgatcccgataaaatcaaagaaatgattcacgctgccgtgcacactgaaaatcccaataaatgcgtaagctttaagcagcagattcacccatgtaggcaaaataatcagcatcagccataattgcttgtgcttcagttttgttaaaaaataagcagtcgggtaactgatgatcagcgtgaaaaacgtgatcaaaaatgcataccatacagaattgatcgtcatagagagcgatgtccccgacgtaaaataagatagataattattcagcgtgaattgcccattcatatcaaaaaaagattgataaatgatcattaatacaggcgcgatcacgaataaaccgagccacaaaatataagggacggaatagatcctgcgcattgttttcattcttgtcccccctattcttcgtagctgtcaagacgtgcatcgaattcttcttcagactcgttgaaacgcatgacatggatatcttctggctcaaaggccaaccctactttgcttccttctttagcttttttcgttgaatggaccatccattcattttgctgttcatcataacagatgatttcataatggacaccacgaaacagctgagtatcgaccgttacgactagttttcctttatctggtgtcgtgatcgtcaaatcctctgggcgtaaaacaacttcaactggttcatttagacgcatcccgccatcgacacattcaaattgcttaccaacaaactcaactagattatcttcgatcattacaccgtccacgatattgctctccccaacaaaatcagcaacgaaatgattgattggctcatcataaatatctacgggtgtaccactttggacgatttcccctttattcatgacaaaaatctcatcactcattgccaacgcttcttcttggtcatgagtaacaaaaataaacgtgattcctaatcgttgttgcagatcccgcagttcatactgcatatctgtacgtagtttcaaatcaagcgccgataacggttcatctagtagcaatactttcggttcatttacaattgctcgtgcaatcgctacacgctgtctttgaccaccagacatttcactgatctcccgtttttcgtatccaggaagctggaccatacgcaaagcatcttttaccttcttttcgatatctgatttggacattttcttgatcttcaatccaaaagcaacgttatcaaaaacattcatatgaggaaaaagtgcataatcttggaagactgtatttacttgtcgcttattagctggcaaatcattcaaccgtttcccttcaaaatagatgtccccttctgtagcttcggtgaatccagctataatacgtaggatcgttgttttgccacagccggaaggaccaagcagtgtataaaattttccttgttcgatctcaaaacttactttttttaatactgtttcatcatcatagcgtttcactacttgatcaaatgaaatgattggtttccccacgtttttaccccctatattacaaatatgattgcgttgcaacaatcaatacttttgttcgttttttgagatgattccttaattgatgttgttttgtcgcttgataatagatcgactgtcctgcttttgccacatagaccgtctctcctaagcttaactctaattccccttctaatacaaaaataaacgtttcagataatgaaggttcaaacgtcttatattctcctgcaccttcaaaagtcagcaagacaggctccatttctttttcattcgaatcagccacgagccattccaattcatacccgttttcttcatcgaaataaaccgtatgatcttcttttgaataaaccacttgcagattcgctgcttcttgatgaaaaaattcttctggagtcacacctaagacttcaagaatagaaaagaatgtttccattgatggtgaacttaaatctcgttccaactgggaaatatacccttttgacaaatctgtgcgttcgcctagttcttcttgtgtcaaattcttttggatgcgcaaatttcttaacttctcaccaatttccataatttcctccgaatcgaagttttctaatagtaaacttactgtttactaccactcgtattagtatacgaaatttattgaaaaaggcaaccctttgtaaaattttttttgctgaatatttctttatcttttggaataaattctagttgtttgattctttatttttcacctaatttttgtctaaatttacggaagaacaagaataaaagagtaggctttatggtatgataaaagaaaattttaaaaggagtgtctcacgaatgaacgcttttcgatcttttcaggtaataaaggaacctgttttccatacagcaatcagtgatctgacatttactgagttggctgaaaatgaagtcttggtaaaaattgcctattctgatgtcaattacaaagatgcattggcaatgagcgagtctggtcaggtgatacgaacctatccgatgactccagggattgatttatccggaattgtcgtccaaagtaacaatccacgtttttcaaaagaagatcttgtacttgctactggttttgggcttggcgtcacccatccaggcggttatagccaatatcaaaaagtaccaggagactggttagttcctctaccaaaaaatatgacgctgcgtcaagcgatgatccttggtacagcaggctttactgctatgttatgtgtgaacgctttaatccgtcaaggtatgacctccgataaaaaagttgtcgttactggtgcttctggcggtgtaggcagtacagcgatagctctgttacatacactaggattccagtcaatcattgccttttccagaaaagaagagtctgtcacatggctaaaaagtctaggtgcttctcaagtcgtacgacctgatgaatttctgccagagacaacaaaagctttaggaaaacagcaaatcgactatgtcatcgacacagtaggtggcgagcagctaagtagtcttcttccattgatctcttataacggtgcagtagctttatgtggcaatgctgggggaatcaaactaaacgcgactgtcttgccttttattctgcgaaacatccagttgattggaattgattctgtcaatgtaccaatagatcaacgtctttctttatggcaacagatggcggatttgcagattgcagatgaactggtcgtccaagagattactctggatcaattgcctgaaacagcatctaaactacttgctggaacacaccaaggaagaacactagtaaatgtaggtgaccataaatgaagattctaatcacagctggaggaacgactgaaaaaatcgatcaagtacgtgctattacaaatcattcgacaggacgattagggcaagcattagctgattatttagctgccaatccggataccacaatcgattacgtgactacgaaacaagcactgaaaccgaaaagacactccaatataacgatttatacgatcgaatctgcactggacttatttttacaattagaagcactaacgaaaaaagaacactacgatgcgattatccacagtatggcagtcagtgattttactcctgcttttagtttttcagaagaacagctggcaaaaaacctacccacttcttcaacgcaagaagaactggacaattggtttgcggaaaatgaacagacagataccactgtttcaaagatctcttctgacaccgagcatcttgtgctcgttttgaagaaaacaccaaaaatcatttcttatctacgtgaatggcagccaaaagcaaaaatcattggtttcaaactattagtagatgtaccaaaggaatctcttctggcagtcgcaaaaaatagtctgataaataacaaaactgattttattttcgcaaatgatttgacggaaatccatggcgagacacaccacggctatctcttatctaaagatggaacagtggaagaagctcaaagtaaatctgagattgctgcattgattactgagaaaattagattggaggaatcaaaatgaaaaagatcttactaggcgttactggaagtatttctgcttacaaaagcgctgatcttacaagtcaattcgtcaaattaggtgcccaggtagatgtgattatgtctaaaagcagcacacattttatcacgccattaaccttgcaatctctgtcgaagcgcgcagtccatacagacgtcatgcaagaatcaaatccgcaggtaatcaatcatatcgaactagcaaaacaagctgacttgtttctcatcgcgcctgctacagcaaacattatcggcaagctagcaaatggcattgcagacgatcttctttcaacagtcgcaatggcgcttccagtgggaacaccaaaattgattgcccctgccatgaacacaaatatgtatcaaaacccgatcactcagcgtaatctggaaacattgagatctgtcggctatcaggaaattgaaccaagagaatctcttttagcttgtggagattttggaaaaggtgccttagctgatattcagacgatcatcgaacaggtcatgctgactcttaatgaaagaaatgcttagaaaaaaggagtacttatgaaaaatacaaaaaactttacattaactgcgatgtttttagctattttgattttattagctgttacgcctttaggttttatccctatcggtccaatcaatgcaacaaccatgcatattcctgtaatcattgcttcgatcgttttaggaccaagactaggtgcttttcttggcggtacatttggactgatcagcatgatccgtagcacagttatccaaacacctttgtcttttgtcttttctccgtttatcccagtcatcggaacagaacatggaagctggaaagccttgctgatcgcgtttattcctcgcatcttgattggggtggttccttatttcgtttataaaggtctgcgcaaactaatgaaacaaaaagcagattccgtttctttattcttagctggactttccggttcattgaccaatacgattttagtgatgaatatgatctactttttattccagcaagattatgccaaagtcatcggaacaaatttaaatgctgtttattcagctattctagcggttatttttacaagtggtatacctgaaggaatcgtcgcaggtcttgcgactgcagcagtatgcaatgtcttgttaagatacttcaagcacccttctcttactaactgatagtcatcgtagccgatctctgatttttttctcttttggtgttactattgaatggaaagatttgacgtcgaaaggatgatccaaatgaaaatttttgttgtaggtgcaaacggacaaattggccgatacctgataaaagatttagctccaagttcccatgaaatttttgcaggggtaagagatgtcgcttcccaaacattagtaaaaaaagagaatgtttcgtatgtctcttttgatttaacttggtccgtggaaaaaatgaccgaagcattcaaaggcatcgatgtattgatttttgctgccggctctcaaggaaagaatcttctgcaagtagacttggatggcgcaatcaaaacagtgatcgcagctgaaaatgcgcatgtctctcgctatctgatggtcagtgctgtttatgcagatgaaccagcaaaatggcctgagtccatgacagattattatattactaaacattatgcagatgaatggctgaaacgaactaacttagattttgtcattcttcaaccagtcacattgactaacgatgaagaagttacttccattcaattaactaagcctaatgagaaggcatcaaaaacgatcactcgctctacagttgctgctgtacttgccgctctagtggaagaaacggatatttcccgtacgactcttgtactttccgaaggcagcaaagaattggatgcagcattccaagaatgggcaaaggaggaatagatccatgcgtgccatttcaatcaagcatcctggttctgtagatgtattagaacaaattgaagtgcctgttcctaaaccaaaacaaggcgaattactgatcaaagtccatacagcagctgtcaatcgaacagatattatgaaaagagaatcagtctctttgaaacctccctaccctattttgggagtcgaagtagctggagaggtagttgagaataaaagtgatatctccatttttactcctgggacaaaagtatacggattagtcaatctaggtggttatgccgaatatgctgtgatgcctgccgatcgtgcaatccttctccctgatacgctagactatgtttctgctgctggaatctcagaagtttttttgactgcttatcaaacactttactggcttggaaaattacaagaaggcgaaactgtcttgatccatgcaggagcaagtggtgtgggaacagcagcgatccaattagctagacagctttctcacgcgaaaatcatcgttactgcaggatcagaagaaaaactcgccttttgtaaagaacttggtgcagatgaattgatcaactataaaaaacaagactttcaagaagaggtacgaaaaatcactgaaggtcggggagtcgatgttattttggatttcatcggcgcttcttactgggaaaagaatttagcttctatagccgttgatggacgttgggtcttgattggtatgctaggtgggaccatagtgcctgagatagaccttggtgtattgattgggaaacgtgtccaactgcttggtacattattgacacctagaagtgatcagtataaagcagagctcgcacaaacttttatgcaaaaagctgggccttttctagaaaatggcaaaattcggccaatcattgaccgtacattccaattcagcgcagtcaaacaagcgcatgaatatatggaagcaaacaaaaacatcggaaaaatcattttgaagataactgaataaaatcatgctgatcaaaaaagaggctgggacagaagcgtttaactccaagaaataagaagaaattcacgaaaattgcttttcaaatttttgtgaatttcagctaatttccaaaggagttgcttctgcttccgccgtttatacgtgtttagagcgtgagacaaaagtgttctttacttttgtcccacgctctttttccgaataaacggtgttcaaaagcttgcatctgcggtaataagtccaaccaagttaaaaacataagaagctgtttttacttggctgttcttattacttgatgcagggcagctttttcacaacctcttcactaaacggtattcaatcagctgaccctcggtattagcttaaaaaacggcaaaatatgaggaactattttgccgtttgtttctctaatactcaggtcaaaacgctgatttcacaacctctttttatttacgttctatttcattcattttccgaagcaaatcgagctgcttgtatgcccgcttgtcgcccaaaaataatgatctctgcaactgaatttccaccgatccggttgtttccatgtaagccacctgtgacttcaccagcagcatataaccccctaattggctggttttctttatctaatacttcagtgttcgtattgattttcacaccgcccatcgtgtaatggattcctggtgcgattttgatcgcataataattcggagacgataagtcatgttccatggctgtggcacggttgaattgagcatcttttttctccgcaacatccgtattccatccatcaactgtttttgctagtgtttcttttggtaaatcgattttttctgctaattcttccattgtctttccagttgtgacatatcctttttggtcataaaattcaatagctgcggcacgatcacgcacgccttggtcaaaaatcaaataagctgatttttcaggcaatgctgtaattgctgcagatactttatcccttgtatccatttcattgacaaatcttttcccctcttgatcgaccaagattgctccttctccgcgaacaacctcaccaatcaagaccccctcatcctgctgcacagttggatgaatttgtattttatccatatcaacggtttgtccacctaatttttcaatcatggtgataccatctccagttgatccttcttgatttgtcgtaatataatcagctaaatcgggacgatatttttcaataaattctttgctggcaccaaaaccgcctgtggtaactacgattgcttttccggtgacctcttttggttcttctccttgaacatgtacagtcacttcattgaccgtttccccatttttcttaatgtctgtcacatctgcgttgacaaaaatagggatttcccgctcatggacgttattcaataacccctccactaagtatccaccaatagccgagccatcagacggacgatgtgtcctcttttcactcatccctccagtgatcgttaagttgtccagtttgataccgttttgatctagccaatcgaccgcatcagcagagtgatcgacaaagtatcgaagtatttctttatcattcgttcctccaccaccttttagcgtttcttcatagaaggcatcattcgagtctttgattccttcttctttttgaaattttgtttctgaagcattcataccgcttgatgatttagatgtgtttcctccggcaacaggcatcttttccaaaattactgtattcaacccagtatcttttacttcgatagctgctgccatccctgcaccaccagctccaataatcacgacatcataagattctttcatttcttttggatctgtatatacttgttcagaagcgcctgatgatacttcggcagattccttcgtactagaacttgtctgcgctgtatttttctgatctgcgccgcatgcgctcatagcaagaagtgcaacggctgttaataaaccagcaactaattttttcatttgtatcccccttttctccttatactatattaagtgatttttttcacaatatcaactctgtttttctttaagtcatatagctttggtaaacacacgcttcttagtataattaaggatatacatgaaggagttattttatgaatcatttgaaaaccttttttacgaacagtacaaaaactgcaggtagaatcacaaacggaatctatattttattacgtatcatcgtcgttattatgctagtggatcaggtctggaaccaacactggggaaatacaatgcttttattactgacactaattttatttgaaatcccttattttctggaaaagatattaaagatacagattccaaatatgctagaaatcattttgttatcttttatttttagttcaacagttttaggtgagttaagtgatttttatggctatttttcaatgtgggatacttttctacatgcattcagcggatttttagctgggggtgtcggcttttcccttgtttatttgctcaataaaaatacaaaaaccatgaacttgactcctttattactagcagttgtttccttctgtttttcgatgacagttggtgttatgtgggagtttgtggaattttcagcagataaattactgcaattcgatatgcaaaaagatacgatcatccagcaaatcaatagtgtggagttaagtaaagacggaaacactgtctatcatgttccagatatcactcggacaatcattgaaagtcaaaatgcagatggtaaaacagataaaacaatcatccaaaatggttacttagacgtgggaatcatggatactatgaaggatttatttgttaattttattggagcagttgttttcagtgtatttggttacctctatagtcgaaatgattaccaaaaatttacgttcatcaagaattttattcctaaaaaaatcaaacgataaaacatgctaaaaaacaagagaaggggcagtgacaatacttttgtcactgccccttcttttttgaatgtatggcatgccattagttatccgatagtattaactcaaaaaagtaagatatgaggaatgactatttcgttttttatcccaatactgaggacttatttcaccatttcgttatttatctaatttacttaaaacctgcataactttttcataatctggattaggtgtgccgtctagattttcagcaataaaagtaaaacccatttttttataaagagcaatcgcctgatggctccatgtctgtgtgtgaagatagattggtccgtccgtatggagggtaggaaattcttgcaagactctggcagtcaatgcttttgcgagcccttttccttggtaatctggtttcactgctaaccaatgaaaaaccggatacacttgctctcttgatttttttcgccaagcggtacaggttgctactttttctcctttttttgtctctacaaaaaacatccttctttcaagttcttcaggataaggagcaaagttttgttgaaaatactcaagtgcttcatctgtcgtttgaaattccccaacggaagtctcaatctccgcccaagcagattcatcttctttttgataaaatcgaaattcaaaaccttccgctaaaggcgtgattggaacattttgttgaagtggtcttgtcatccagatttctgcgtaaggtaacgttttatctaacatttttctatccctcctcgtctccattatgccaaataacatatgactcagctacttatttgactataacagatagagatataaatcagaaccagtcatctgcgtcaaattcatttcgattagcgtatacccatgttcctgcgatacctcgcatgaaatctcctaaagcagaagaagaaggaatacctccaccaggtgcgggtgttcccggactaggaagtggtacttgcggctgcagatgctcatcggtggaatcaatagttgacaagcgttttttcttcgtttccttgtggtcatctgattcattctgatcttccgactgtttagcaacaaattctttttctgattgttgttttattttaggctctaaaatttcattttccaatccagaaacttgtgaggccaaatgagcttcttgccttatcgttttattagattctgagatttttctagatattcttgctaactctaggcttcttgtttgttttactttccctgttggagaaactgcatgagccatttgttgtttttttttctgacaagctttcttcttgttttttttgttctttttgtcttatctgtttttttaatggtaaaacgtgtaaaagcgactgagtgttgcgttcttggagtgaatacgggtcatgataactatacataatcgtaaaatcacctgtctgtttggtcaaataaccatcctccaatggttctccgttgattgtaaccgatacatcctttaacggtacgggtttacctaaggaatttgttgctgattggatcaactcttctttgtttattttttcgtttggatgaacaataagatcatgaccttctaatgaacgattgtctggtatataaacataagtaaaggtaatttcccctcctgattgcttcctattattcatcagttctgagtgaagtacttcaaggatctccgaccagtgactttttctgtctaatccgtttgcttgcatccaatcagaaatagaagtgactttcccattttgttcataagtcgataaatctatatttggcactcgatcagaaaattcagcaggtaggcgcaaatcaggaatacgatttacactactcatatgtgtttctgctcgaagttctttatttgtttgactatctataaaatgagtgatgacagtcgatgaagcagcagatgcttctacataaactacagctgttgtttctgccacatttgatgttttcgagtctatataagttaatacaacgggatattctcccggagttgtagtatctactgtcccgttcattttgatttcttctttatttcctgaagttccatcgctttttgttacatattcaacaagatctttaggggcgtaactctctcctgttcttaagtgaagatcttttcctttgatagctgtttgatcagcacgaacatggatcacagcagatgcagtcattgtttttaaagcaattggatcaaaataggacaaggaaatagtagatgttcctgtattagtcgtatccacgatattcccattgtttgaaattactttggacatatctccttgtgttccatctgcgttcttcagcctttctaccagatcagatatcgaaacttttgtccctgccagaacatcgattttctttccttcaaactgtgaataatctttttcatatacataagaaacttgtgcgcttccaccgtcctttatatctgtcaaagcatgattcaaaatatcagtgatctgttttaactgatcaccttttgtaggatcagtcatatcggaaaagatagaaagcggcacactgcttccggtttccgatgtccataatgttttgttaggaattaaccagtagtggtttatcgttggaggataactgactttattataggaagtcaatgcaggaagtagctgttttccatttgcatcagtgaaagtatgagtaatagtgataggggaatcagtggtctcagaaacagaggtacgtacgaccttgatggtttgtgtcgttgcctgaacgggtacatgcatatagacacctacagataaactgatcagcatcgtgcgcatcataaacttaacgtagtgtttttcagaacacgaccgttccttatctaaacgacaagcgtgtttatttagttgttttgaacgtctttttgaacacatttattcttagtcctccctactcttgtctaaacatgaagtagtaattttcataagatgatttcattatataaataaaatcaaaagaagatggactattaggagagtattttttttgattttttattgtttcaagaaaatcggaataataacttatgtactttttaattttgttaagtaatatatctagttatatctagttatatctagttaccttttctttgaaaaaaacataaatcagctaataaatatgtgagacaaagctgccatccataaatactagctgattttttcagttaaatgtctatttttttctctgatgatggtatttccaaaatattcccagtcatctggagtcggtggatttttccaaattatctgttctttattaaatttttcaagtaaacaatcagataaataaatattcgtacgagaagtgattcgactctcaatcacaatattgtaatttttaaatcctttcacttgagaaataatgtaatcggtataagcagatccttgcgaaaaatcaatacagacatgaatcggtgcttcaaaatatgataccggacaaataccgaccaataaaaagagataatcataaaataagcgaatcatgaaacgttcatcttttcccaagaaatagcgtttattctcttgtatgaccttttggattgctgtactgaatattggatacgtctcgaagaaaaactgtagctgctttttagacgtaaagctagtcatctcaaagtcgaatatccaattttttcgattgacatgcatcatacccatacgaagttcttttcgtatatatagtctttcttcttcagagatttcaatcgaaaatggtaattgatcaatcaattccactgacattttttgactaatcatgtggatatcatgaaaatgagcttccgcaagtccaaatgcgccatctaattcaaattcttcttccgtgatcaaaaacaacatgatataagaaatctcatcaatgatctgctctttagggatatgaagaaaagaaatatgtgataaatccttgatgatcttcattccttctgagctcttaaagtattcatctgaaaagaaacgttttccgattggttgattcccataggccctcaacaaactaatagtggttagcaaattgaatttgattcgttttgttgcagacagttttaaattgaacagatattcaaaatattgcacgatactctttgcttcattcatgacgctttctctaaatggcatagaaaaaccattaaagaccccgaaatataccccaaataatacgttccgtatgtttatttcttccccaactaatatgtttttctttaactttatttgatgctgttcaagaaaagagactaattctcttctttttacataggctcttgatatgcttaaaaaatgattctctgcaaatttttcgatcgttacttttgaatccacgatctccgttaacagtcgagcaatttttgatcgttgaaagtagattcttcttaaatttttgatatccgtcaaattcagacgttcgacatggatctctgcttcttctgaaatttggatctctggctttgttttgaattcagtaaattctttatttaattctatgatataatttcttgttttaaatttagacaaacctaatgtttcatataacttaggcagcactacataattctttttctcaaattctaaatatctagctagcagcagtttttctctatcttcctcttctataaggtaatccaacttcatatcctacacctcaaaaaatgcctcataccaattacttgatatgcagatgaaagttcatcttttcacctatactgattttatgatggattatgcttgttttttcatcagttattctcattttttatctttttttgagaatattgcaaaaaatggaaaaatttatgaggaaatattctatattttttgttttattgtgttaaactgtacaagatttgcgccatttgcgtaaacaaccacaaaaaagagcagggcggccaccgtcctgctcttttacttattttaagttccattacttattaattggctaaacttctgcttgtttctgatattgcttgtttttctccaatgatccgcacttctgtttctaaagacacatcaaatttttctttgattacttcttggatgtgcgcaatcaattcaatataatctgtcgctgtcgcatgatcgatattgacgatgaatccagcatgtttttcagagacttgtgcaccgccccatttcaggccttgcaatcctgcttgttggatcagctgacctgtatagtgtcctactgggcgcttaaagacacttccgcatgaagggtattctaatggctgttttgattgacgcaattcggtcaactcatccattcttgctttgattgcttcataatcccctgtttgcaaactgaatcgagcttccaatacgatagcacgtaattcttggactttactgtgacgataagaaaataccatttcgtcttttgtcaaagttttcaatgttccatcttcaagcaaaagatccacttcagcaaaaacatctttgatctctccgccatacgcacctgcattcatataaaccgctccaccgacacttcccgggatgccgcaagcaaattcaaatccagtcaatgattctgccaaagctgcataagtcgtatcaatcagtgaggcacctgcttccgcaatgaccatcgttcctttgacatgaatctgtttcatttcagtcagcatgatgactacaccgcgaatcccgccatcttgaacgatcagattgcttgcatttcctaataccatccaaggtatatcatggattcggcaataatcgatgatttgctttacttcttcttgctttttcgggaatgcaaggacatcagctggtccgcctgttttcgtaaacgtatagttcatcaatggttcatcaaacaataaagtaatcgtggctaagctttcaactatttcttctttattcactgaggattttcctttcttttctcaaacgtcctcattattctatcacgcttaatacaatcttgccagtcttgttcaaagttgatgacggtagtgatctttaagcacttcctcacataattcatgacttcttacaacttctttttgtttaagcatttctgtttccgatttacctaaacggatctgagaaaagaaggcctctaccattggctcaaacccgcgtttgactagcgtgtttgtccagtcgccaaattctttcactttttttccatcagcatcttgaatgacaagctgggtcagatcgtttacttcataagtaccatttttacttgttacttgatatttttctatattagcgccacttgctaaatccatcgttaaaatagccgtttgattttgtgtttctaattgtaaaatggcatattccaaaaattcctttgtttctcttatctggtattttgttctcaaaatgggttcatctaataaatacacagctgtatcaataagatgtaaaaacaaatcataaaggacgaactctgtcgttccttttgccgctattcgatttttttgcaggtggatcaaccgcttatctgggatacgtttcaattcttctaccataggagcaaagcgccggttgaaaccgatcatcaaaattttttggttcttatcagctaattcttgcaattcacgaacttcatttagatggacactcagtggtttgtcaatataaacatggataccattttctagacattttttggctaattcataatgtacttttgttgctgcgtggatcatacatgcttcgattttttcttctaaaagctcatcgatcgtttcatatagatgttggaacccgtactctttttgaattctttcttttgtttctttatttcttgttgcaaaataaaaatcaagtgttccttgttttttcgcataagttggtaaatatgctttttctgcgatattccctacaccgattacaccaatcttcatcgactttcctcctggatcatttagttactttcatcttacaccattttttactaaaatgaggtacaatagtatcgcaaaggtaaggaaattaattcgaaggagtgtgcttttattgaaatttatctcttggaacgtaaacgggcttcgtgccatcgtaaataaaaattttttagaagtttttcatgagttagacgccgattttttctgtctgcaggaaacgaaactccaagcaggacaaattgatttagatcttccaggttattatcaatattggaattacgcggaacgaaaaggctattccggcacagcgatttttgctaaaaaaccagcattgaatgccacttacggaatgggtatcgatatccatgatacagaaggccgtctgattactttggaatattccgatttctttcttgtaacctgttacacgccaaattctcaaagcgaattaaaacgtttagattaccgattagaatgggaagaagccttttataattatttggaaaatctaaaaaaacaaaaaccagtcatcgtgtgtggggatctaaatgtcgctcatcaaaagattgatttgaaaaactggaaaacgaatcaaaaaaatgctggattcactccagaagaaagagcggctctttctcgactgttggataacgggtttatcgatacattccgttatttttatccaacccaggaaggtgtctactcttggtggaactaccgattcaattcaagaaaaaacaatgctggttggcggatcgattactttttgacgagcaaagatttagagacaagactagctgatgcaaagatccatacggacattatgggcagtgatcattgtccagtagaattagatttgaaataaagaggttgtgaaaaagtcgtttagtttcgagtattaagaaaaattttgtgaaaatggctttccacatttttgcataaatttggcttaatatcgagaaactggcttttgaacaccttttattaagaggttgtgaaatcagcgttctgacctgagtattagagaaacaaatggaaaaatagttcctcatattttgccgttttttgagctaataccgagggtcagctgattgaacaccgtttagtggagaggttgtaaaatcagcgttctgacctgagtattagagaaacaaatggaaaaatagttcctcatattttgccattttttgagctaataccgagggccagctgattgaacaccgtttagtggagaggttgtaaaatcagcgttctgacctgagtattagagaaacaaatggagaaatagttcctcatattttgccattttttgagctaatacctagagtcagctgattgaacaccgtttagtggagaggttgtgaaaaagtcgtttagtctcgagtattaaaaaaaactttgtgaaaatggctttccacatttttgcataaatttgacttaataccgagaagtcatgatccctatctaactccaaatcacaaggaataagttcaaaaactagcttttttcaacaaatattacataaaaaattctatgttttttgttaaatttatttgcttttttcaaaagtatgttacagtaatttcccaaggaggttttacagaaatgaattttgttgccatggattttgaaactgccaatcatcagccttatagtgcttgttctcttgcgctagtcatggtaaaaaacagccagatcgttgatgaattctatacattgatacagcctgagactccttttttctggcgaaatgtccaaattcacggaatccatcaagaagacgtacgcaatgcgccgaaattcccagaagtctggcaaactatccaaccatattttcaaaaaaatcgtttagtcgttgcacataatgctgcttttgatacaaaggtcttagcgggatgcttagattattatcatcttgaacagcctaattatctttctttatgtacagtgaaaagttgccgtcgcttgtttcctgaatttccaaatcatcgattgaacactgtgtgcgaaaatttgaacatccaattagatcatcaccatgatgcattggaagatagtcgtgcatgtgcggaaatcctgctttatcaagaaaaaaaattcgggacagatccattgaaaaaacttgtgactataaagtaaaagaatacttatgaaacacataaagaggtcgtgagtctgcagtttcactccgagtcacaaggagcaatttcaaaaaatagctcctcatgtttattaaatattgtgactggtgaccgaggagctggcaggagaacaccgtataaggaagaggttgtgaaaaagctgttctgcatcaagtaataagaacagccaaacaaaaatagcttctgatatttttcatttggttggacttattaccgcagatgcaagcttttgaacaccgtttaccaagaggttgtgaaatcagcgttttgatctgagtattagagaaacaaacggcaaaatagttcctcatattttgctgttttttgagctaataccgaaggttagctgattgaacaccgtttattcagaaaaagggactgtgacacgacttttgtcacagtcccttcgtgtgtttttctgccttctcaaaaggatgacagtttctcactcttttcctatttcttctattcaatcaaataactcattttatatacatctaaaaattcacctagatctgttcttgcccctctaggcatgaccgcttcgatttggaagcccatttttcggtaaaggtgtacggctctttcattacgaacttgaacgtcaagctccaatcgaaaaagtacacccatttccttcgcccaactgatgatttcttctagcataagagtgcctagtcccattccccaatattcctgcagaatactgataccgacttctcccacgtgagacaaacgaaattgactgtctgccttgacagatgctgttccaataatcgtcccttcatagattgcaagcagcaataaattattattgctttcgtatatataatccaactcttcttctaaggtttctggtggtaacaggagttctgcttcatccaaaactaaaaattctgtctccttattgacttgtcccatcatcaaaagaatgtcttttgcatctcctggcactgcttcccgcaagatgatcccaacttcttcactcatgattttcagcccatttttctagaattcgctgtttgaaggtttcactttgctccccgtatgagattagtttcacataccgcttttctaaatctgtatcacttttttctaaaatcagttccaaataatcctccggcagtgcttcttctaatagatttccccattcgacaacggaaagcccatcaccttcaaaatattcatctaaccctaaatctgctccgctagctgctacccgataaatatccatatgatacaacggaatccgaccttgactatattctctaataatcgtgtatgtcggacttttgatcatttgcgttatccctaatccttgggcaattcctttcgtcaacgttgttttacccgcacctagatcaccagtcaatatcagattgtcacctggcattgcggaatgaccaattgcctctgcgaattgttctgtcattgttaatcctgatagttcgatcatttttcatcttctcccgcttttctttctttttgccagtatatcgcgtaatgaagtttttttaaagaaaaaatgaactagtcaagaacagcagctgctgtttttggctagttcatgtgtatttgttaatcaatcaatgtttgtgctgctgtgataatcgataatttatatacatcttcttcatttgctccacgagacaaatcagaaaccggtttgttcaagccttgtagaattggtccgattgcttcaaagttaccgaaacgctgagcaattttatagccgatatttcctgactgcaattctggaaatacaaagactgttgcttgaccagctacttctgaatctggcgctttcagttgtgcaactgaaggaacataagaagcatcaaattgcaattcgccgtcgatcatgtattgtggcgctagttttttagcgattttagttgcttcaactactttgtctacttctggcgatttcgctgagccttttgtcgagaagctcatcattgctacttttggttcgatatcgaacaattctgctgtttttgcagaatctacggcgatttcagccaattcttgcgcagttggattcacgttgatcgcacaatccgaaaagacatatttttcttgatctcttccacgtaccatgatcatcgctccgcttgtccgactgatgccaggctttgttttgatgatctgaagtgctgggcgaacagtgtcgccagtcgaatggatcgctccagagaccattccgtctgcaatccccatatacgtaagcatcgtaccaaagtaattcacatcttttaaaatcttttctgcttgttctttggatgcctttccatttctgcgttcaacaaaagcatccaccatttcatcccacttatcgtaattatcagggctgatgatcgtaaagctagatgttttgattcctctggcatgcgctgcatttcttatttcttcttcgttccctactaaaatgggttccacaagttcttctgctttcaaccgggcagctgcgcctaaaatacgagcatcagtagcttccgggaaaacgattttgatcccacggcgaacaatcttaaatcttaaactatcaaacaattccacaagatgacctccagacgtttttatatgtattatcatacactattccagaaaaaaagaacagtttattttatctgtatcagtcaaaaatgctggaaaaattaagtttttcacatacatagcgaactgcgctataacaggaaagcgctgttttattacactgtttcaggtggttgccaatcaatcggttcttctcctaacgcaaggagcgcatcattcgttttcgagaagggtttggaaccaaaaaagccacgacttgcagataacggactgggatgtggagatgttatgatgatatggcgactcttatcgatcattttgattttttcttgtgccggttttccccacaagataaacacgattggtttttcccgttcatttaatttttcaatgatcgtgtctgttaatctttcccaacctttcccgcgatgagaatacgcttgcccttcccgaacggtaagaacggtgttgagtaaaaggactccctgtttagcccatgacactagatttccatgttgaacaggtgcgattccaagatcatcattaagctctttatagatatttcttaacgatggcgggatctttacgccgggttgcacagaaaaagataagccatgagcttgattttctccatgataaggatcttgtcctaaaatcaccactttaacttcttcataaggagtcaattccaatgcttcatagatatgatacatatctggatggatcttttgggacgcatattctttttttaaaaattctcttagatgcagataataatcttttgaaaattctggggacaaaacttcttgccaactgttatgaatgatttctttcaaaacctccacctcctaataaaaagaataactcacattttcttcaatcacaagggacaatcttcaccctcagcacttgattaatatggtaaactaggaacaagaagcagaaaggaacgataatcattatgatcaaattaattgcatcagatatggacggcacattattagatgcccatatgagtgtttctcctgaaaatgccgaggcgatacgttttgcaaatgatgccggtgttgagttcatggtcgctactggtcgaaactatcaagaagctcgcgcagctttagatgaggtaggaatcgattgtgcgatgatcactttgaacggggcacaggtatttgataaagaaggaaattcactgtttaccgtatcgattccaaataatcaagcaatctctgttttagatattctagatgctaacggtatttactatgaagtagcaaccaacgatggtctttattctgaaaatcaagcgaaacgaatcgaaagttttgcttccatggtggctacccatttacctcaccttacgtataaaatggcgattgccatggcctcagctaagctggaattattgcacatcacatacgtggacagtattcgtgctatcttggaagaaaagaatctggaagttttaaaaattatttgttttcatacagaagggccagctgtattaggtccagttggaaagcagatttctcttttaggcgatctggccgttacttcctctggtcaaaataatatcgaagtgaaccataaaaacgctcaaaaaggaattgctgttgcccatgtcgctcacgagcgtgggatttctttagaagaagtcatgacgattggcgataacttcaatgatgtcagcatgctgcaagtagcaggagtcagtttcgcaatgggaaatgcagaaatcgaagtaaaagattatgccaaatatacaacggacacaaaccttgaatctggcgtaggaaaagccatattgcgcgcgattgcagaagacttgtagttttatctagaaaagagggatatagatgtcagaatttttcattcaggaaaaacagcttggacgtgcaactcggacaattgtcaaaaacgaaaaaggacattccctgtttttgatggttggtcgctggggaacaaagggcgatgcattgtctctttatgccatgaatggcgatctcgttgctcacatcaagcagataagcctgacattcggtacgcgttttgagctgtataaagagttcgaaaaggtgggaaccatgcagaaaatattcaattggcccggtgatttttattatattcgtagacttcactggacagtccaaggtgatatctataatcatcaatatcaaatccatcatttcaatcagcaaatcatgaaaatggataaagcaacacttttttcaggagattactatgtattggatgtctcaaatgatgaagatgctccagtttgtatttgtattgctgcggttttagattactggctctaccgtaaagacaaaagcaaagaaaagcctttatcctatcgatttgatgtgaactagaaaaaatgaaagcaagctaacaataaacaatctcaaactctaagtcaaaattaagaatctacgatattgggagtcgttacttgatcgagtaacgactcccaatatttcttatcaaaaataggaaataccaaaattcccttcgagacggaggtattcaaacactcttgatgatgaactaaaaaagtgctgttttatccttctatattctcataacacatattaagactttaatcgtccgataggacatcctccattcgatctgactgttcctctatatatccctacataccaaaatcttcctgtagtaaaatctttgtcgtaagaccaagtttgtaaatataattgcccacaataaataccatcattatatataattgtatttgttagaccgcttaaagtagccgatcgtcttgtgtggtagataactttactacctctgctattgatagtactcattacttgctaagcacttaaatcatttgtatcagcatggattttttgtgaaaaagcggttaatccccatatagccattattaaaataaataagttcttaaattttttcacttatattatctccttcctgatatttatttttgaaggaatcggtaaaggtaaggaatggtgataaaaatatccctcataataacctcgagttccatttgaaaggggcatttccctatattttccaagccaacctcgataggctccagattggaagaatgcaacagctggggcaggatttccagtcgttgtccatccgcttgtccaataacgagtcaatatagcttgtggggaaatagtgataaacttcatttgatcaaaatcaaaaatagtagtttctacaatgtgagaaggagcatcctcaccatagctaaaatcttttgcttcagcatggacacagttattacttaataaaacagcaacggacagcaaaaaacagctagataaaaaacatttttaatcataaaaaacctccatttatatttttatatcctgattatatattgaatttttatgcataccaaacaaaactttaattatattactattttttcgcaaatatggtaaaatatcagaaaaaagaaggtaaaggagagggacatatgaaaaaaaagttattaaaaagaactatttatacatcgcatttgttattattattcatatatcagcggttgcaattcgaattacaataaaataactcacgtcacaatagaacaaattacagctaatggaaccttacaaactagaggaacttatattttagataatgggtatttagaaatcagtaaagaatttaaacaaaatataaatttaaatacctctccaacaaaattgttaagcgaaaccgatcgactgttactggctgaaatgattaaagaagactttccttccgaaactatttctactgaaaatccagagttactgcaaagtttcaacaggaaagtcaaaaatggaagagtggaaatcgattctgataataaaaaaacttatctaatcggaaaagattacaaaaaggaatttacatgggtagctgataaccaaacaagattgaaagattcattcggagtcgaatacagttttacaacggatagcaaataggactgtgacaaaaatcgtgtcacagtcctttatttcgaataaacggtgttcaaaagcttgcatctgcggtaataagcccaaccaaacgaaaaatatgagcagctatttttatttggctgttcttattacttgatgcagggcagctttttcacaacctctgatacacggtgttccagaagtagcttcttttcttctagtctacacaccttaatttttctgtctagttaattgtagcctatccatcgcgtcatgcagcaggtctttgattattatcagttgccactgttcgaggatgaatatcattatatatatagtgatacattcgacacgattcaccagcaagacgttatgaaactagttgagaatgtgatttataaagtaagtaaagcaatcaaccattctttttatcaagatccacaattgttgacgaatctgtatgctcatttatctatgcgattatcgagaaagaaaaaatttgtcaatgaatataatccttttaaagaagatatcaagcagaaatacccggaattatttgatgcgatcaagcaagcagttcgacaagaaataagtgaacaaaatattctgatcaatgattctttcgtggcatatattgccttacactttttggtttcctacgaaagagaagaagatctacgaagcgttagagccgtctacatttgttcaacagggttgggtgtgactagtctgatcaagcaaaagatcaatgaagaattaaataatatcactatcgtggcatttgcttcagtattgaatgcgcaagaaatgattgctaccaaagatcctgatttggtgattagtatttttccaatcaatggcatcgatcgtcctttcatcaaagtccatccattacccactgaacaggacttgaaaaaaattcaacaaataataaaaaaaatactagcttcttccaatcagcaggaaaggcataacttgaatcttagagaaacgtccatcaataaagatactttagaagactttagcaaggaattgattttgaaagcttatacgatttatgaacgtttacttgtcattttggaagcagaattgatccaagaatatcgagaagcttttttgcttcatgtattcttaatggttcatcgtatcacatttgatcaacaatatatggcagaaggtcgtcaagtagatcagattattttagacaaaggaacactggtaggaaaaatcgaagcagtttttgcagaaaataatttaggaatcaatcagtcagaaatcagtgcattattctcatatataaaagaaggagcgtcaagttagtgaaaatgtcagacgaggctttaaaaattatcgaggaaagtcaaaatcgggaaaagttaaaacaagtgattgatctaattgaagagcgattagtagaacatgctattgtaccaaccgagttgcagtggaccattctaattaatcacttgaatgagatgctgaaacgttctcaaagaaaggaaacgattcccgtagtcgatcgggatttgttcaaagaagtatccaaagaagccataactatttctgatgaaatagttagaagtatcggtaatttaaccgatgatgaaatatatgttttgtcgattcattttgaaacagcaaaaaataattaacatttaggaggaaacaatcatgattacagtagttattgcagaccgtatgggtaaaggacaaaatgtggccaaaggggtagaagcagctggcggcaaagcagttgtcgtaccaggaatgggggcagatatgcgtttgggcgatgtgatgcaacaagagcatgcagatatgggtatctctttttgtggtagtggtggtgcaggtgcattaacagcagcaacaaaatatggctatccagaacgacatggtatgcgttcgattgaagaagggatcacagctatcaaggatggcaaaactgttctaggtttcggctttatggatcaagaggaattagggaaacgtctgacagaagaatttatcaaaaagcatggaaaatagaaagagggacatgaaatgagcgttcaaaagacaattcagcaaaaagttatcgtctccggtaaagaggaaacaaagcaacatgcttttgcatcagcgttagcagaaatttaaaacaaaataatggaacaatcaaatgtattattgcgaatcgaaccagtcaatgtggatattttaaaggcggtcgaaaacaaatacacagaacgctttctatttttcttcttcccacggcaacgtatcagctatgaagtcgaaatttctgttactgtggctgtaacagaaataaaattggcagacatatcgttcagccagcaaatgactgaagatccaaatgggattgccattccatttgtaactaaaaaaatctaattttgaattataagggggaaagaataacgtggatttcgtaatcattctagtcaaatcggttattatcgggggattacttggttttgcagcatctgtcggggcagctcgaatgtttcatgcacctaatacacaaggtttaggagcttttagaacattaggcgaaatgaatgcctgcatgggtgatccagcttctcatttttcatttggtttaggctttttctttaatgcatgggcttcttcagttggtgctggtgcattcacacaagatgtgacgcatcgaatcattcccaattgggcagcggcagcacttctagcaaaaaacaaagatgtcacccagaccatgcatgatccgaaaaaaatggggatcattggagcggttatcggggcaggggtggtagccttcttaaacacaacagctgcagcaattccagaggcgttacaagtgacggcggtttccgttttggtaccagcagcgacgattctgatcaatacagtaatgccagttattttttggttggcagctttagatgcagggaaacgaactggtttttggggcactctttttggcggtatcgcgcaattgatcatgggaaatgcggtacctggtgttgttctaggaatcttgattggtaaaggcgtcgatgagagcggttggaatcgcgtcacgaagagcatgatgatcgctattgttttattatttattttcagtggatttttccgtggatttgatatggaaatgatcaagagcttccagcttcaagtgcctaattggcttgataacttgcacaacatctttagtgtgaaataggaggagaatcatggagacaacagaagaacaagcaaaagtattagaagtaaagcggcaaaagagcttttggtttgcagactggtcttttccgctaatcgtaggaattatgtccgctgctgtatttgcaggaacacacatgtatgtgatgtatggtgtgggtgcattcaatgaagtttcgatcgtggcgatgttaaaagccgggctggatggcggatcctatggcgcagcggcagcgtttggtgctagtttcttatttgccagaattttagaaggctctttagttgggatcttgaacttaggcggttcgatcctaactgggatcggaattggggtaccagcaattctcttaagtatgaaaatagcggcaccaatcgataattttgcactctctttattgactggtttggttctaggtttgattgttggtggcatcattgtcttgattcgtaaatttacgatcaatcaatcaaattccatttttggtgctgacgtcatgatgggggcaggaaattcatctggacgttttttgggtccattaattatattaagcgcgtgtgcagcatctattccaatcggcattggcgctacattaggagcactaggattctatgcttggaaaaaaccaattgctggaggtgctattttaggagcaatgattttaggagcaatcttcccggcagtaaatattgtagtcggagcgatgacaggaagtgtcatcgcaatgctttcaggagtgacagatcatgtcgctcatggcggtccaatcgtagcagttttaggagcagtcgatcatgtagccatgttttttgtagcagtgattgcaggtattgctgtcactgtgttaatgttaagaattttgaaaccaacattacaacatactgcagttgctgcagcaaatggtgtgacagtagcagatctatcagagactgaaacaagtgatgtttatacgaaaactgaaacttttgattctattacggagattatgtcagatgaagccatcgttctaggagaaacagcaacaacaaaagacggagtaatcgaagatttagtccaacgtttagaaaaaacagcggctatcacagataaaaacgggtttaaagaagtcatctatgatagagaaaaggaaagtacgacgggaatcggtatgggaatcgctattccacacggaaaatcagcttatgttcttaaaccaacagtggcttttgccagaagtcaagatggagtagagtggcattctttagatggaaaacttgcacatatgatctttatgattgctgtacctgaaaacagccaaggagatatgcacttgaaaatactgcaacgtctttcacgtaaattgatggatgatgatttccgtcaagcattgatggatgcgccagataaagcagcggttcaccaattattaagtgaaatgtaataacataagatgaaaaatcgaccgtgatgagacataatagatgtgttatcatgatcgattttttatttggaagggagtttctgcttattatgaatcagcgtcagcaatctttgatttaccaattaattgaaacgaataattatatcacaataaaaaagctagcagagcatttccatgtgtcggaaagaacggttcatagcgatttgaatgtcattgaaacttggttcagagacaaacagctgcctttgatgattgaaagaaaaaaggggacagggatcttgttgaatggtctgcctcacgaaaaggaacaattgaaacgagtgcttaatgaagaggcacaaacagaaatggataaaaaccagcttcgtcaattattgattttccatctgctagtagcaaaagacggatttagtcttgaagagctttcagaaaaactatatgttggaaaacgtacgattcgtaaagaattgacagagctgaaaagcttttttgagtaccatcatttacagctagtatccaaaacaaaacttggcacttttcttaaaggcgatgaacaagaaaaaagacagctgcttgttaagacgctacgcaatatgcagaaagaagatccgcaaagtccttcgttgaaagagttttttgccaaagatacattaaaagtcatccaacatacattaaaagaagttttctatgaaaatcatctggaacagccaggaggactggctagtgtggagattcatatctattttatgcttgagcaaatgaaacagtaccagaaagtgaaattaagtaaagacgaaaatgaagtcgttgagcatacccaagcacagcagttaagtagtcagatcttagcaaaactagccactatttacccaattgaattttctcctgatgaaatcaattatctggctttgcgtatcgccaatctttttacaaactcacaagcagccacacgatttcaaaaggaatctagtacacttgctgatcatttgattgtacaagtggagcagtttttaggttattcattgaaagaagatcagttactgaaacaaaacttaaggtctcatttatcttcgacctattttcgactccattatggcttgcagatttctaatccactgacgaaaaatgtatttagtacgtacacacaactttttttagttttacagttgattctagaagattattttgagaaagaaaatttttatgttccgcaagatgagacagcttatttaacgatccatttccaagcggcgatcgagcgacacaaacatcagaaaagtaaaagataccaaacagttctagtcagtgaatattcaaaagctatggctacttttcttgaagcacggctgaacagagaacttccggaattaacgattatagatttaattgaatataagccagaactagagagggaagattttccacctgttgattttattttgactacattaccgtttaaatatgaaaatattccagtaatcgagatttcaccaatgatcacagaaactgatctggcctatttgacaaaatatatgctggaacgtgtacctatcaagaagaaaaaaacgtttgatctagcaagctttactcatctatttttgatctttcctcagcttgaatggactgacccagtagatattttaaattttatggggaatgtcttagtagaacatcattatgtggagccggaattcgtcgattctgtcttggaacgagaccgtcacgccagtactagagtggcaccatttgtaacgattcctcacggtaatccgctgtatgtaaaacattcgatgatttctattgcaacaatgaaagaaccagtcctatggcatggggaacagatacgtatcgtactgctgttagcaataaagagaaaggatttgaaacatgcagagttcaaaaaaattttttctgttattcactatttagaaaagcagccagaacaaatggcacagttgatgcaatccaatcatccactagagattttaaccttgttgtctagttatgaataagcagatattaaaaaactgcctttatatttataataattctatctatttatttgaagttgaaaaactaaatacaaagggactgtaacaaaaatcttgttacagttccttcttccgaataacggtgttcaaaagcttgcacctgcggtaataagtccagccaattcaaaaacatgaaacgctgtttttgtttggctggacttattacttgatgcagaacatcttttccacaacctctatttaatgaaatggattatagaatcgtccgtcatttaggatcactaataaaatccctattgaacaaaaaaggacaacgagaaatagtgcaagataatcattccgttgcaatggttttgccgacagccatgtccgtccttttttctttccaaaacgccgaagttccatggcagaagaaatcatctcaatacgttctaaactagaaaaaatcaatgggatcgcaatcgtcaaatttcctcgtacccgtttcatgagagaggctttaccagagagttcatttcctcgtgcttgctgggctttggaaatcgttcgaaaatcctcttggatatctggaatgtagcgtagcgctaaagaaaaggcataagcaattttataagagccaccgattcgatggatactagaagctaattcacttggattcgtcgttaaaataaaaatcaaacctggaggaatggtaacgaaatatttaatcagtaaattgaattcataaaaaaactgttcttgagtgagcgtatatctaccgattccatcaaagatgacatggcgagtaccatagatagctactccgtattctggggcaaataaataaacagtcaataaattcaaaatggagaaaaaagcaatgaacttcaatacaaaagagatctcagaataactaattctggctatccgaaaaatgagaaccgaaaacacagcaaggcaaagcaaaaatcgtgtgtcataagagaccatcccaataatcgaaagtaatagaaaacaaaaaagtttggtaaaaccgctgagttgatggatgattgtttttttcggtacataaccgatgagattattctctgtcataagggtcccccttatgctgaataaaagccgaaacgaatccgctagcatctgtcagctgattgctttttgccaaatgatacaaactagttttccgcaagcttgccgaggtaactaaatcggttgaagatagtaccttcgaaggtatttcatctgcaataatttgtccttctttcaaaacaatcgtccgttctgtatattccagcatcaagtgcatatcatgagtgatcatcaaaatcgtgaggccttgctgattcaattttttcaaaaatttcatcattttagtgtagtgatagtaatcttgtccagctgtcggttcatcaagaatcagcaattctggttcgagtaccaatatagatgcaactgctacccgtcgtttttgtccatagctcagcgctgaaatcggccagttacgaaattcatacaatccgcatactttcaaagtttccaagactttttcttggatgtttatcggatcttcaccgcgattttctaaagccaaagcaacttcttcaaaaactatgtttttagaaagcatttggttactgttttgcagtacatagccaattttgtctgcgcgctctttgatgctttcagatatgatagattggcctttccacaacagttcgcctttttggaaaggaaggaaaccggtgatgagattggacaatgtggattttcctgctccattatgtccgactaaactaaccatttctccttgatgaagagttatatcgattcctttgatgattggttccttactgaagtggaaggatacatctttcaatgtcactagcggcgttttctttttagaaggagaacaaaaagtcccttgttgttttgctaaagcagcagcaatctttggggaaaccagttgatcgacttgtgttaaatctgggaattctgtcaatgagagtccagaacgttttaatgctgtgatgtataagggttcacgaattccgcacttcgacaataaatcacttttcagcaattcagtaggagctatatccgcaatgatctttccctcatcaatcaagatgacgcgatcgactggtgcagctaacacttcctccaaacgatgttcaataatgattgtcgtaaattgttgcgattgatagagacggtcaatcatctggattgcttcatagcctgtctgtggatcaagattagctaatggttcatcaaacaagagaataggtgtttcatcgatcaaaacaccagccattgctacccgctgcttttgtccgccagatagatcttgcggacgtttgtctaattgggccagtaaatttgtcttttttgcccagaaattgactgcttcttgcatttctttttgttcgatcatctcattttcaagagaaaaagcgatatcttcagctactgttaatccgacaaattggctgtcagtatcttgtaaaacggtgcctacttctaatgaaagatcatagatagaagattcactgaaatttttaccattgatcgttaattgaccagtaaaacttcctttttcattttgtggaatgatgccattcaaacattttcccaaagttgattttcctgagccgctaggtcctatgatcaaaattttttccccaggatggataatcaaatcgatattttttaatgttgcttcagcttggctgtcatattgaaatgtaaaattacgaaactcaatcattttagttcctcacgttctaagcttctttgttcaaacttccttttttgacttttgtctgtgcataagctttcaataaaataatgccgataattcccgtcacaatagcatttgtgattccagcaacgattccttgcgtgaagactttacttggggcctctgcataaatcaaaatatctcccacaggcgcaataatcacccatgtcactaaattggcaatcgtttcacccacgaggaagagcgtgatttcttttttaccaaatatgccttcttcaatcgggatacgtttggtcagtaaaccaaaaaacacacctaaaatcccagatgcaatgatccatgcccaccaagcaccataagtagttaaatcacccagtgcatggccaataaaaccagctaatcctgcaacgactggcccgtaaactacgcctagcagcgctagaaaagggtaagcggtcgcaatatccgtatttggaacacctgttggaatggtgacgaaacgttttaagataaagaagacagctgctccgataccgatagctacaatatgctttactgtaaattttttattcattctattttcccccaattgtttatttatgaatacgcatttccaatttttgaccacatcatgtcaaaattttgttggatgattcgaaattttccgaaaattcacttcctttcgatagtatccaaggtcaagtagtggatggactttattagtatcgatagtcgattcaaaagtgggtacaaaaaaatgccctagcaaaaaattgctaagggcatagatatgcgttaccacctttggttataaaatcctcacagactttacctcgatcagtacccaaaaaaatcatcttttggaaactgtgccttgttaacggtagacatccgtatttccttaaatattcgggaaatccgctcaaaagccattttcaagtaacagatacgcattccttttcaccaagcaggaactctctttggcgtctaacattactttactttctttgtcatcgcgtttcattgattgctaataaaatagcagagaagtatccatttgtcaacgggaggaacgattgatctagcaaaaagaagagaagaagtttttgctagagaacaattctatttatcagttaattgtaaaaacatttttgagaattcctttataaacttggagcatattgatttaagtcagaaacctttgttttgattacttctctgacttttctgaattccgctaatatttcttcttcgctcccgacagcttgtgcaggatcttttaggtcccagtgaaggtgttcgtgattgtttggaacggcagggcacttgtctttggcatcaccacaaagtgtaataatcaagtctgcctgagcaaagtaatctctatcaatcaaatcagatgtttgtttggaaatatcgatgccgtcttctgccatgatttttacagctcttggattcaaaccatgtgtctcgatccccgcacttctgatctcaaactttgaagtagacagatatttacgcgcgtagccttctgctatttgactgcggcaagaattacccgtacataaaaaatagatttttttcatttgatttcctccgttatggattagtacgttatggattagtaattgtaactgtttatctaaagaaaactctatatgatggagcgaaaaaaacaatgggtttcttagtttatatgtttctttttgttcagcgtataaattgatgtgtacaaagaactcatcctgtcttttttaccataaatacacgttagaaacaatcattttgagtcaaaaaacaacgatgggaaagactattaaaagagattaagacatggcagatgatgaaggaagtaggggtatagtcagccgatagatttcttgaatatgacgcgagaacaattattcgtcttttaagaaaaaaagtagtagaatcagttcatattaaaaataaaaaaccttccatttttgtagggttggaggaggtcattaccttgaaaaaaatcggctttttaagctttggacattggatggatcaaggatcgctcgtgaaaacagctcaagatgcttatttgcaatccatcgatttagcagtggaagcagaaaaaattggaatagacggagcgtttttccgcgtacatcattttgcccctcagattgggccgccgtttcctttgctagcggcaatcggcgcaaagacgagtaagatcgaaatcggcacaggacttatcgatatgcgctatgaaaacccttattatatggcagaaaatgccggattgacagatatcatcacacaaggaagagtgcaactaggagtgggtcgtggttcacctgaacaagttctagatggctggaaatactttgggtatgattacagtgaagaagaaatcaaagaggtgacacgggaacgcacccttgaattcttggaattacttgaaggaaaaccatttgcagaaccaaatcctcaaccaatgttcccacaaggatcaggaaaattacggatcgagccttattcagaaggattacgacaaagaatctggtggggagctggttcgcagcaaacggcaatctgggcagcacaacatggaatgaatctgcaatcatctacattagtcaattacgaatcccatgagccgttccatatccaacaagcaaaccaattacgtacgtataaagaagcgtggaagcaggcaggtcatgattttgaaccaagaacattggtcactcgctcgatccagccaatcaccactgatttggatcgacgcttatttggacaagaccgtagtccgcaacaagatgctgtcggctatcttgcttatcaccggaacccgacgatttttggaaaaacttttgctggtgaacctgatcaattaatcaaggagctagctgaagatgaagcaatcaaagaagcagacacagtacttgtcacgattcctaatactttaggcgttgaatacaacatgcacttgcttgaaacaatcgtaaaagatatcgctccagaattaggatggcggtaaaaaggatatttctgtaagtgcaggatacttgagtgaaaaaataaacacttctaacaatcagttagaggtgtttattcatgttttcatgaagttcatagagaagaaaagtgagttatccgtttgttcagtgagattgttcataagcttcttttacatgttggggtaaatcttcaggaatcagtttcaatacggcttcttcattgccggtttttattgcttcttcatagtaccagcttttgtaatttagcatagcgagtactctttctaattttgttatttcttcttctacaacttctttttgcttttcaaatagttctttacgaaccgcaaatgtcttactgccttctttgctccattccatgaattgcttgatgtcttttatttctaaaccagattttttcaaacaatcaatgactctcaaagcctctaattcactctctgaaaattttctaataccggaaacacgctggatatcaggaaataatccctctttgtcgtaataacgtaaagtagaaacaggcaatccaaacatttcagacacttgtccaatggaatacataaaaaaatcctcctaaattaaaattttatccttgacctaaagtcaggtttaagttttatcatgataatacattcaaaaacaaatgtcaattttgatcaaaggagcgtttagaatatgagtaaagaattaaatatcacccaagaatgggacaaagtatttccaaaaagcgagcaagtcaatcatcgaaaggtgaccttcccaaatcgtttcggtatcacattagtcgctgatttatatgtaccaaaagaagtaagtgaagagaaattgccagcaattgctgtgagcggaccatttggcgcagtaaaggaacaatcgtctggtctatatgcgcagacgatggctgaaagaggctttttaacgattgcatttgacccatcgtttacaggagaaagcggaggagtaccacgatatgttgcttcgcctgatatcaatacggaagattttcaagcggcagtagactttttatctgtacaaaaaaatgtaaaccctgagagaatcggaatcatcggtatttgtggatggggaggtatggcattgaatgcggcagcgatcgatacacgggtcaaagcaacagtcgtctcaacaatgtacgatatgactcgagtaacagcaaatggctacttcgatgctatggatgaagatgcccgatataaaatgcgtgaagaattaaatgcacaacgtatcattgatttcaaacaaggggactacgcacgtgttggaggagtggttgacccattgcctgaagatgctcctcagtttgttaaagattaccatgtgtattataaaacagatcgcggataccatgttcgttctttaaattctaacgacggttggaataggacatcagggttatcacttatgaatgcgaaactattgcattatattccagaaatccgtcatgcagtattagtcattcacggggaaaaagctcactcacgttactttggggaggatgctttcaatgagctgaaaggcgataacaaggaactcatgatcattccagaagcttcccatacagatctatacgaccagacagatatcattccatttgaaaaaatggcaacattctttgaagagaaccttgtgtaaccaaaagaggttgtgaaaaagccgcttctcatgtttgttgaatattgtgacttgtgaccgaggagttggcaggagaacaccgttattcgaaaaaaagaactgtgacacattttttgtcacagttctttttgtctcatttcgtgtaaacaatcattcactttatactatttatttcatttctgtgattttaatattttttgctaaattttttacatcagctgggataactttcccgacttctgattgctgtgcattcgacatgccgcaagccattgcataccttatacattcttttaaaggataattctgttctaatgaatgagcaaaacctccaacagtggcatccccagagcctgttgtattcgtgataggaatcttagggatttcaacattccaaaattcttcttttactttgactactgcaccatacgagccgcaagaaaccatgatgacatcgatatctttaaatagtggatttgtttttagatggtgttttatgtcgcttttttgagtgattttttgatggatgatatctgaaaactcatggatattaggtttgatgaacatcggtttatacttacttgctaagacttcacggagatgttgtccagatatatccattaatatataggtggaaggatctatttgttctttgatatattgtaataatttagcatacaaaaagggatcttgattgttgacagaaccatttattgtaatgactgaaaggtaattatttttactgatttgtttgatatcattcattaattttttgatagtagcatctgctattttaggaccagcttccacaagttctgtctgcgtttcaccatcatgcatgatggtgacggcacctcttgattcttctgcaataggtaaaaaatgcaaatcaaacagattttcattttgcagcatatcttgaatcataccgccaaaataaccgcccaaaaaccccgttaaaataactgatgaacctagtaaagcagatgctcgtccgcaattgattcccttgccgcctacatagcgtaccggagaagcaaagcgtgtcatcgtacctaattcaaagtgttttgtaaaataaatggaatcaatggatgggttcatcgtgattgtcagtatcatttttgggctcctttaatatggttaagtattttgaataatgatggaaatcttgttctgataaatgattatcggttattagataatcaaaatcggttaattttctaaaagtatagacatctgatttatttaattttgaataatctgtaacaatacatttgattttggctgcattgagcgctgcattttgaatatttccctcaataaattgagcagttgtgacattattttcaaatattccatttgttgcagcgaaagagatatcgacattcaaactttcaaaagatctttctgcaacttccccaatgaactcttctgtaataggagaaaattcgccaccagtaagtaaaatccgataactagtatgattcttcaaatagttgaaagcaatcaaactatttgtaattacaaatagatttttcttttgaatgaaagggagtgcatacaggatcgttgtaccggcgcctacataaatagtagaattatccggaattatactgttcatgacttggccaatatattttttttcggctacattcgtatcaatcttttcttgagtcgatagttctcgattataaggttcctttcgttcaacgccaccatacagcttttttactttatttttttttgctaattcagtgacatctcggcgtatggtcatttctgatacgcctaatttgttagcgatttctgaattagttaaataaaaatctttctctaataacgtaatgattcgttcttgtctttcttttttcaacatatgaattactcctttaacataaaagtcaatttttgttcgactttgttcttcttgattatatagataaacgattttattttcaagtagatcaaatttaacaaaataaatttcttttgaaagcgttgacaaaataaactaacagaaatataatgttcttgtaaacaaagatgaacttagtagaacataaaattaacaaacttaatcaaaaaagagggtggagaaatggaatataaagagatgtttgttcctagtctgattcaattagcggtagacgtaaaaaataaagaagaagcttttttaatagctgcccaacgattagaaaaaatggggtacgtcaatgagaattatttgaatggactaattgcaagagaaagagaatttcctacaggattgattactaagtatttaaatattgcactgccacattcggaatgtgaatatgtcgaaaagccattcgtttttgttatgcagctgaagaacccaatttatttttatcaaatgggggataatcaggaaatgactgtagaaaatctattttttttaggaatcaaagaaccaaaagaacaagtaggattacttcaagcgtttatgaatttattcatggatgaaacattcgtggaaaattataagaaacaagaaacaccgcaaaaaatatacgaacttattacaaattatatttaggaggaagaaaaatgaagaatcggttaattgtcgcatgtggaagtggcgtagcaacgagtcagacgatcgcgagtaagatccaaagtatgttagaagatgatggcattacatttcctgtagaagcagttgattacaaatcaatccaaaatgagcttcctactgctggaatctatgtgtatgtcgcacagccggatgatgaagtacttgaacaagcaaaagatttaggtattgaagtatttccaggaattccatttttaactggaatgggcgtagaacctatttatgacagtatcaaagagttaatacagtaaaggaggattgttggataaaaaattgtctcctagtttttctactatatttcaaaagaaagaaggtctatttatggaagtcttccaaaccgtgatcaattatgttttgaatttaggatcagctatttttgttcctttgattattttgatacttggattattggcagggatgaaatttaaaaaagcattcatgtctgcattgactttagggatcgcttttagcgggatgtctatggtcattggctatatgtctaacgcagtaagtccagcatcagaagcattggctaaaaatacgggaatcagtttgcctgcacttgatcttgggtggacaggtgcagcaagcatcacatggtcgtggagttatgcttttatattctttgcagtaactattggggtcaattttgtactgttactttttaattggacgaagacgttaaatgttgatatgtggaatgtttgggggaaagctttaactgcttatttagtttattatgtttctggcagtttggctgcaggctttcttacagcaatggttcaagtcatattggaattaaagcttggtgatatgtttcagaagcatatacaagatctcacagggattccattagtaacagtgactcattttatgacatctgccgctgtcttgttgctccctttcaatatgattatggataaaatacctgcattgaataaacgagcggatacgaatgcattgaagaagaaaattgggatcttctctgaaaattctgtaatgggattcattattggcttgggacttggctttgctgctgcgtacggtgtttcaggttctcttaatctagcgatccaaacagctacagcattaagtttgtttcctatgatctctaaaatgttcatgcaatctttgtctcctttagcagacgcgatgtcagaatttatgaaaaagcgatttaaggatcgtgaagtatatattggattggactggccgatattagctggtcgttcagagatttgggttactgctattttacttgttcctgtgtttatcggttatgccattattttgccaggaaaccaagtattaccattagcagggatcatcaactattcgattgctgtcggcggattgcttctaacaggaggaaacttggctcgtatgctgatcctgggaatcctcacgatgcctatttatttgtacggtgccacttatcttgcgccaatactcagtgatttagcagaaaaaagtggagcagtcgagggaatcaagaaaggacagttgatcacatggtcatcaatagaagggccggagttcaggattttatttgcggaggcatttaatagaaatattctcgctattgtaggatgcgtgatttttctaggactgtttgttctactttataaatatatgataaaagcgaaagtcccgagcgaacgttatgctgaactacaaaaatagcattgaaatggtgggaaagcaatgaaaagagaagagacagataaaataaaatggacagtcgctctttgtggtacacttctgctatttctatatggactctttactcagaatatcatcatcaatctattggtcatttttttcgcgctagtgatctataaatatggaaatcacgttttattcagagagtacgatgaaaaaagaaaacggaaaatagaagaatcaataaaaataaaagaagctaccaaagaaatattgagagaaaaaagttttataaaaagataatggaggggtcattatgtcagatggacgtatgttatttgagagagaacgacaggacatggcacgtatcgtaagagtgattttcgaaaggaaaaacacaaatgtcgcaggagggaatttttcctttaaaaccactgatgatcaaggaaaagactacatcatcatgacgccgaccatgatgtcagaagcctatctaggagagatttctcctgcacaggttctagtagtagaaccaagaacgcgtagaatcgttgacggagtcggtcatttaactcgggagatcaatatgcatgaagcgatgtacgagactaatccagctatcaaagctgttctacatgctcatgcgcctaatgcaatgttctgggcgactactgggttgcctatgcctaatttaacagaagccacagctaaagtaaaagagattcctgtcatggactttgagcctaattgctctgaagaacttgctgaattgacaagcgattacgtaaaaacacatgatttagaattgccccatatgttattactcaattcacatggcgtattgatcaacacaggtggagaatcaggaatcgaagccatccataaagcactgcaaatccttgatacagtcgaatggaatgcagaaattgcctacaagcagacgatttttcaagcactagggattactgatggattttattcgaaaggtgagaaaatcggcagattggaagatttgaaacataaaacggctatttataataaatctgttattacagctagcggagactaacctatctgacaaaaaaactacgactttcacacactatgatccagattgatgtctgcttcaggttgtgtcatgtaagtcgtagttcttttcttttatttagttagaagatgctctgaccattccctcgcttgctcgatttcgtccatcgtcaactgatgacctgttacagttagctgaatcgtcacatttgcttgacgtgtttcgaattgatcggccaattctttaaaggaagcaggggaaacgattggatcgttatcaccataagaaagccagacggttttatcctctaatgtggaacggctttgatgaacacctagagacatcggatggaaaaacaaccctttatttagcttggtctcacgctccaataataaatgagcagcgatgtttgcgccatttgaatagccgacaagcagccaatcgcttaaagctatctgttctttttcgctgatttctttgattttttcatggagtttatctgtttctttttccaaactgtccaggtcgaattgattcaatcaattacgcttgaaaaaacgattcatcccatcttcttggaccgtgccgcgaaaagaaagcaacgtactgtttggtgcaagaaagtgagcgatatccagtaaagaatgttcgtcgccacctgtgccatgaagtaagatcaaatgcttgccacttgttcctttttcaaaaatgtaggtcattttgttccctcttttctgtttctatagatgcaaatgaagtagcatgaagagattattcacgttttttatttgcatcacttgtatcgaaaggacggacataggcttcaatggcttcacgacgttcttctaagaatggaggaagagatagtttttctcctgctgattctgctggttcatcttcaaggaatccaggaccgtcagttgctagttcaaacagtacgtgatgagcggctaggaagtactcagattggaaatagaaacgatcgacgaaaccagaatttggcaattcgatcttattgattacttgaatccagtattccaatgcttttttgtctgctacacgcaatgctaagtgatggatatttccaaatccttcgattgcttttggcaagtctgtccgatgttcaataataatgcttgcaccatttccgccttcaccgatttcaaataagtagaaatctcctgaatgatctgtttctttgaaccctaagattttttcaagaatcaagcggatatgctctaattgactaacacggacaaagacaggtccaagtcctgtgatcgcaaactctgtcggtacattgctgtttttccaaggaatgccagctgctacaccttgattattttcgtcagagatcaattgataatattgattatcgaaatcttcaaactcgatatattttttgccgaaacgttcattgattgctgaatgagtaacgtcatatttttcaaatcgttctaaccaaaagtctaatgcagcgtcacttggcacacggaaagaagcacgggagatcgtatctgttcctttttttccttttggctgatttgggaaatcaaagaaagtcatatctgttcctggcgcaccagtatcatctgtaaagtaaagatggtaagtttcgatgtcatcttggttaacggtttttttgattaagcgcattcctaaaatatctgtaaaaaagcggtagatttttgttgcgctagatgtcattgctgtgacgtggtgaattcctctgatttgtgtatccatgataaatttcctcctgttaacttacaaaaagtaagtagtcgatttagacatagtatagagggtgcatctctattttgcaattaatttgtcttctaaagtatcaggaaggaatcaagaatggaaaagaggaggaacggatcaataaaataaaaagacttacgactagctgcatcgatttcaaaaaaaattagctttaaaaagctaactttagaatcattacgggtggtcataagtctttttatgattagatggaaacgagcttctgaaagtacttagtaaatgttattcaaaaaattgtacctgtgacaatcaatcgactcgaaactaagcggcttttccacaacctctgattcacggtgttcaaaagccagtttctcggtagtaagtcaaatttatgcaaaaatgaggaaagccattttcacaaaatttttcttactactcgaaactaagcggcttttccacaacctctttggttaagttgaacgcacatccagcacagaatagttccgaacatcaaatcggtttcggctggaagaatattcaatcggctggccatctttgagatagacgacttgctgaacttccagtacaggatcgttttctgcacagttcaaatattgctgatcatattcatcacttttatctgcagaaatagcacgataagcccctgcaaaatggacattcaattcttgatgaagatgatcatagatagaggctaacaaatgttctttttttaaacccggcacaagatggactggcataaaggtatgctctaaaacataaggctcgccatctaagatccttaaccggtgaatattgtagacaggttgctcggcatcgatcatcaatcgttcttggatatatggatcagggaattcaacatcaaaatgaatgatttgacttttcaaagaacgatgtctgcgtttcatttggagactcaaaccttcatactcgttagcgggcgatgtgtctttttgcataaatggatgattcaagattttcgttcctgatcctcgctgcgaatagacaagtccttccatcgctaagatattgatggcttttttgattgtcatccggctcgcaccaaattcttttaccaagtccacttgattaggcaaaaaactatcgggaggatactcttttgaacggattcgttcccttaaaatatttgcgatttcttcgtattttggcacgttattcacctcttctagagtataacgaaagattatgcttccgacaactcgaagtagcatctggaacattgtttattcgaaaaaagaggatatgacaagtttcttgtcacatccccttaatgatccattaagcaatatctaaatctggttgtttatctaatactttcaagaacgggtaccagataaaggcaacgatgacaaagtcgatgacttgcagcataccgccaagccatgaatttgttgctaagacaccgcttgcaatgattggcacagtccatggaacagagacgccagttggtgcagggacaagtccagcagccattaccaaataattgaacgtcgttacgattagaggcgccacgacccaaggaataaggattgttgcattcaatacgatcggcagaccaaagatcgctggttcatttacattgaaaataccaggtgctaaagctaatcgaccaacatcacgatactgtttctttttaagaacaaaggccatcaataaaacgacagctaaagtcattccagagccaccaataccaacagtgaaggtttccatgaatggttttgtgatgatgtgtggtaattcttttccatgttgataagcttctaagttatcaagcatcagtgtattccagattgggtccattacagagttgacgatgatttgtccgtgaagtccgaagaaccataagaattggacaaagaacaaagcaatcaatgttgcaggtaaactacttcccaaaccagttaatggtttttggatcacttcataaacgacatcatgtaagttagcattgaaaataccagtcatcacagcgttgattactaagaaaatagttagtgtcactacagcagggatcaaagcggcaaatgattttgttactgcaggtggaactccatcaggcattttgatctgccagccgcgtttcgtgattctgcagtagatttctccagccaagaaagcagcgatcattccaatgaacattccttttgcgccaagacgatcaagtgaaagaacaccagttacatcttcaccaccaacggttttcattgcaaaaggcgtaagaatcaagaagctggcaaaagacacggcaccaccgaaaataccttcaacgtcataagattttgataaataatagccgataccaaaagtaacaaaaaccgacatgatgctcattgttgcattttgcccattaccgaataagttcgataaagttccctttgttgcgtcactgaaaaaaggcaagttattgataacgacaacgatcgaaccgaacatcgttaaagggaaggaaagcataaacgcatcccgtaaaactgtaaggtaacgattttgccctaataaattagctaagggcatgattttctcagaaagcttgtccataaaaccgttcatttttattcacctcaaatttatttgcaatcgattacatacaaagtataacgccaaatattttaaatgtctagtcatttttataaaaagtattgatttatttttttaggttcgttatgattacgatatcaagaagaaaagagaggaagtaaaaaaatgaaaacctacacatttccagaaaatttttggtggggttctgctgctagcggaccgcaaacagaaggaagagtaagtaatgacgggaaaggagaaaatatttgggatcattggtatgcattagagcctgaaaaattcttcgatcaagtaggacctgaaaaaacttcgcaagtttacacaaaatacaaagaagatgttcagttaatgaaagaaactggccataacacatttcgtacatctatccaatggagtcgtttgattccggaagggacaggtgaaatcaatcaaaaagctgtttctttttatagagattattttactgaattgctgaacaatggtatcgagccttttgtaaatctttaccattttgatatgccactgtccttgcaagaaaaaggcggatggttatcaagagaaacggttgacgcttatgtttcttatgcagccgcgtgttttgaattgtttggagacctagtcaaaaaatggtttactcataatgagccaatcgtacctgtagaaggaggctacttgtatcaattccactatccaaatcatatcaatatgaaagaagcggtccaagtaggctatcatgagaatctagcaagtgcaaaggcaatcaaagcctaccatgaaggcggtcatgatggtgagatcggaatcatcttgaatctgacaccaagttatccgagagatgaaacaaaccaagatgatgtaaaagcagcgcaaatcgcggatgcattcttcaacagatcattccttgatcctgcagtgaaaggcgagtttccacaagagttgatcgagattgtcaaaacattgggtataatgcctgacattcatgaaggagacttagaactcatcagagaaaacacgattgacctgttaggaatcaattattatcagcctcgtcggatcaaagcaaaagaaacaccgatcgatcacgaacatagccccatgccagatgattattttgataattacgacatgcccaataaaaaaatgaatccatatcgtggatgggaaatttacgaaaaaggcatctatgatattttaacgaatacaagagagaattatggtaatatcaaatgctatatttctgaaaatgggatgggggtcgaaggagaagaacgatttgttaacagcgaaggcatgattgaagatgattatcggatcgaatttgtgacggatcatttgaaatatgtccatcaagcaatccaagaaggaacgaattgtgtggggtaccacatgtggacatgtatggacaactggtcatggacaaatgcctacaaaaatcgctatggctttatcgctgttgatttggcacaagacggcaaacgcacgatcaaaaaatcaggtcgctggtttaaaacggtctccgaaaaaaatggctttgatgcctgatattttttgataaaacgttcacaaaatgtttgtcctaacactgtaatcgtgctacactaacagtgaaggaggcgtttacaatggtagacacttatcgtaatattttagtagcaattgatggttctgaaaaggcagaaaaagcatttcttgaggcaatcacgattgccaaacgaaatcaagcaacgttgcacatcctgtatgtcaatgaagtaacaggcaattactttggtgattttgcatttgttacaacaagcctgcaggaagaattggatgaggttgcggaaaaccagatgaaagaacatcgaaacttggcaatcgaaaaaggcctgacagatatcgagacatatgttctttacggttatccaaagacactgattgctaatttccatgaatcgaaagaaccaatcgatctgattgtcatgggggcgacaggtctgaatgcggtagaacgtgcgctagtaggttccactacttcctatgtagtcaaccacgcatcatgtaacgtcatggttgtaaaataaataaattaaaggaacagaaagcaaaaaagcataacgcttctcttgctttctgttcctttttattttttgcaaaaaattactttacctgatgaagtaatcatgctatgctgattacaacgacagatggagtaatatggaggagagaacatgatttcaagtgatggaatacgcggatacaatgatgcgattattttatcgatccttaacaaaaacgattcttatggatacgaaatttctaaaacgatccgtgagaggacaaatgattcctatgtaatcaaagagacgacactttactccgtttttgcccgtttagaaaagaatcaattgattgtttcgtaccctggtgaagtgacccatggaaaaaaacggacctattataaaatcactgaaataggacgtaatcttttagaagaaaaaaagcaagagtggctgacgacgaaagacgtggtcgatcaatttttggagggaaagtaaatggatacaatccgtaattatttagaaagtctttttatcggagtaccccgaagtaacgagatagaaaagctgaaagctgatttgttggcaaatatggaagatcattatcatgaattaatgggagaagggaaaaatgaacaagaggccattggtacagtcatctcgacatttggttcaatcgacgaattattagaagaattagatgtcaaaaaagaaaatccaagtcccgtgacggaatcaaatccagcttcgatttatttaagcgaagcagaaaattattggaaagaatacagagcagcaagtcttcaagtagcgtcaggtgtcctattcacttgtttatcctttgcaggatttctgttcttctgttcaacaggctatgcattcatgggtgtttcttgtctgattttcggtatagcattagctgtcggttttttcatcgcttctggtatgaaaatcacccgcttaaatcactttttgtataatagaaaaatacctgaaaaagtattagcagaagcaaaagaaaaagaagaagcatatcagcgaagttttggcttctcgttgattgcaggaatcggattatgtattttttcacttttcccactttttgcttcgattttgtggtatatagatggtagtatcggtgcctctggattttttgttacagtaggaacgggtgtctttttgattatttatggcagtcttgttcgtcattcttatcgtcagttcacccaaagcacttattcgtggtaagtgtgcgcaaatttgaacgccatgaatcagaggttgtgacagaagtagttatcttcaagaaatttcggcttatttttcgtagaagctacttctggaacactagttattcgaaaaaaggacggtgacacttttttgtcaccgtcctttttatatataataatttaaaaattcatcatctaattccatagaattgtctagatcgcttacccacgtgaaatcgttatagacagatttgagctggcttctacgccattgtacagggataaaaagacgcatactatcttcattgaacccgactaataatttttttccgtcagtaatgatgggacgttgcaacaaagtaaaatgagacacgattaaatcgacaagttctgaggtcgtacattggtcaatttgatctttcaaatttttataatcaatcgatcgtttagctaatagatcgtcaaatccgttttctgttaatgataataaataaaagatttcttttctggttaaaggctgtttaggtgtgaaaattcgttctctgtaaggcatttggtggtctttcagccaatttgccatcagatggtaactatgtgtacgagaagaatagatcgtaagcataacaaaactccttaaattttccattaatttgttcgatctgttgagataaataataggtaaggagctgtgtataagcgtgaaacaacccaaacatcaatagaaataactttctaaagtcttaaatttgcgacgagaaacaactagactaatagaaggaatgtctcagccatttggcttcctgtttgtttttcttgcttatgctgcagctcctcgggaaagggttctaacaatttgaagaaggttgatgattgatctagtttcaattgtgtgaaatttgaaatctggtgtttttactagatgaatcatctaacaactatgattataacttatagaaacgtcgttttgtattctgttttgttatagttgttataaagttttattttattacagagcatatttaattaagagcgtatagttaaaagttaaaattgctgatgcacatagagtttatgacttcttggaaattctttttcaatcagttttttcatctgtttatgaaattctttttttcagtaaacataaaggtttgggtatcgtaaccttcttcatttaggaaatagattcttcctttttctgtgttttgcgtataagcttttatactcctgtcttttttgaaagaacagatcgtatagttttctatttggtctgggagacgtttgattttcttcaaaatgacttttttatcctcaagtttcattttttcacctgactttattttttatcatatggaaatcatagcgccattggttatatgaaaacaagaaggatactgaaatatatacaaatcgaatagcaggtatttgttattagaataactagttcaaataaatgacaactattttctgatttattacaaatgttttttcaaataaatttgattaccaagaaaaggtagtggtatatttactgagggatactttgaaaaacatataatagaaacagtaacagcatcatgaaaaaatttttttataaaaatggagggatcgatttaatggaagagcagtatgtacaagcaatgacgatcgcaggatcagatagcgatggaagcgcagggatgcaagcagatatgcatacattctttacaagaagtgtttacggtgtttctgtcatgaccgcatgtgttgcaggaaattcttacggaatcggagcaagtgtgaccttgccaaccgattttatcgataaagaatttgaactgattgcagaggactttcaaatacgtgcagctaaaacaggtatgctagcagattcaaatttgattgagacagttgtaaaaaattatcaaaaatatgattttggaccattagtcgtggaccccgtgatcgtaacgaaacatggaaatcttttactagaagaatctgctttgcaaagcttgaaagaaaaacttgtccctttggccgaagtactgacacctaatttttacgaagcagaaaagctgactggacggacattagcaactgaagaagattttgtgcaagcagcaaaagaactgcaagagatgggtgcgaaaaacgtcatgatcaaaggacatcatgcaaaagatgcgcagcaagaaacagtcaacgactacgtattgcttgaatcaggaaaatcattttggctgaatgcgccattttatcctactgaccggatcaatggaactggcgattcgttatctgcatgtattgcagccgaattagctaaaggaaaaacagtagaacaagcgatccgattggcaaaagactatgtaaaccgtgcgattcgtgaagaaataaacgtagggcataaatatggaccaatcaatcattgggcagccagtgaattagagtaaaagaaagaggttgtgaaatcagcgtcctgtcctgagtattagagaaacaaacggaaaaatagttcctcatattttgccgtttgttgagctaataccgaagttcagctgattgaacaccgtttattcagaaaaagaggttgtgacacgttttgtcacagcctcttttcctacgattagtcaagtaaaaggtgtaagaaaaatagctcataaacgaaagcgacaaaatcaaggcacaccaaataaagcctcgttcgtaaaaaattttcgatctgggcaaggagcggcaggaacggaagaagaatttaaccagttgaatgatcgtcttttctcaacaattttgtttgtaaatatacttactttatcattaacattgttgtttgctatagttattattttcttagttggaaatataatgcttgcagtaggactaattttatttagtttagcattaagatgtaatcttgcagaatttttcttatgcaaatacttagatgtaaaagtaggaagtaaaattatattagaaaccgtattaacaatcttgtttattattggtaacatagtattcgacggtgggttcttaagtatggttgtttatttaattagtttcttagtatatatatttattattagaaaaaatttggtaaaaagtgccaaagaattttggcatctaatgaaagccgataattagtttgatatttaagttaatagaaaataaatatgtgcaattggagtgaaacttttggatactatattggttactggcggagctggttttatcggttcaacgctagcgaattatttgggaaaagaaaacaaaatcgtagtagtcgacgatttatcaatgggaaaaaaagaaaacttggatatggagaaacaagtgactttcattgagggggatgtatcagatcctcaattgatggaaagaatcatgaaagaatatcagtttgcctatatttttcatctagctgctgtagctagtgtggcagattctgtagaacggcctgtagaaacacatcgtgtaaattttgacagtgcgcttttattgcttgaattagcacgaaaatatcaatctaatttaaaacgattagtatttagttcctcagctgcagtttatggtgatgaaccaacactgccaaaaaaagaagaatcagtcatccgtccattaacaccatatgctatcgataaatttgcagcagaacaatatgttttggattactgtcatttatatgatgttccgactagtgctgtccgattttttaacgtttatggcccaaatcaaaatccgaactctccatatagcggagtcatttcgattctagtggatcgttacaaaaaacaattggcaggagaaaaagcggaatttactttatttggcgatgggagtcagtctagagactttgtttatatagaagatgttatacaagcacttttacttgttgccaaggaagaaaaagctttaggacagcaattcaatgtcggtacaggaaaaagcactacgctacttgaattgatccattcaattgatcaaatcttaggaacagagctagcgcttaaatatgaagcggagcgttcaggggatattcgtgattccttagcggatatttcaaaaattcgttctttaggctatcagcctaaatttgatatattgagtggaatggaacggtatttaaagtcagaaatcaactaaaacaaaaaccagcaagatgctggtttttttgtttcgacttagctttttaaattaacaccttccatcagttcataaatctgatttcttaaatcagtggccggcaatttgatgtttttatctgattggatattactttccataacgatggcatctttagtgtcttttttcatcgccactactgcatggaatcgattgatattcccctgagcaaggatataatcgtttccactgtaaacaccgccgctgtaaggatgtttatcaccattattttgccacaatgagaaaagtagttcttttggtatgataccgccagaaagaacactggtaaagaatttgttcaagtcataaacagacatacttatgtttcctgtacctaattcatttcggatgtcggtttcaggctcgatcaatgcttttgaataatcgtcagttgcagacatctggtaagatacagcatgttgaggcgaattttttacattgtcataaaaatctgtatgttctagatggagaggacgaatgatttctttttttagaagagtttcataaggctgattcgttagtttgatcaatatccctgtaagcaatgtataattcaatggttcataatgatacgtatcataatcagtaagtttcaaatgatgaagggcgaactgaatgatttcactatccgacataggtttgtcgggagaagcagttcgatgaagaccagagcgcatataaagcatatttttgattgtgatttgctgacttccaggaatctgaggataaaattctgctaactttgtgtcaaaagttaacttaccagcttggatttgttttagtatcagtaaagcagtcattgctttttgaatcgaaccgatttgatagtaaatagaaggtgaattcgattcttttacgcgcagatttgcatatccatatcctttttctaatagtacgcgattatttttgcgtacataaatcgaaccgatataatctgatttttgtagtaattgatcaattttgctagcaagcatctgctcatcgggcgttaaattggaagtaagttgtgttggctccgctttataagtttgggactgaggtatttttgttaattgacctcctataatgatacctgttgaaaagaagcagacagacaataataaaattacaagaaaagaaatagaaattttttgtttttttcgatgttttccttttgacatgttaattcctttctatccatttttaactatttttcattgtaatcctcaaaaagagtatttgccacttacaattttgacataatatttggtaaaataattcacggcagtagaaatttcatgtataataaacagagttacgaagatgatagtaaggaggagttgttttgtcaggaaacaaacaacacccaagtaaagataaaaaagaagccagtaaggcagctacagcagatataatcgacaagcggagaaatctgcgtaaaaaagaagataagattgtgaggaagatcattttagtgattgctcttacattattaattattggcggatttcttggatttaccgtgtatcgttatgtagatagcgggttgaagcctttagataaatcagatgaccaattagtccaagtggagatcccaagtggctcttctaacaagcagattggtgagattttggagaaggacaatattattaaaagcgggattgttttcaattattatacaaaatttaaaaatttaactggctttcaagctggctattatcagttagcgcctaatatgactcttgacgagattggcaaacagttgcaagaaggtggtacttctgagccaacaaaagttgcagatgggaaaattgccattccagaagggtacgatatcgatcagattgctgaacgggtagcgaaggtaactggtaaagacaagaaagaatttttagatttagtgaatgatgagactttctttaacgagttgcaccaaaaattcccagaactgttggaaagtgcatctaaagctgagaacacaaaataccgtttggaaggttacttattcccagccacatatgattattacacgagtacttcgcttaaggatctagtgattgaaatggtgaacaagacgaatacggtcatgcaaaactattattcagctatcaagcagaaaaatttgactgtacaagaagttttaactctagcttctctagttgaaaaagaaggcgtaaaagaaaatgatcgtaaaaacattgcacaagtcttctttaaccgaatcaaagcaaatatgccacttcagtcagatatctctgttttatacgcattaggtgaacacaaagaattagtgacgtatgaagatacatctgtagattcaccatataatttgtataccaataccggctatggacctggaccttttgacaatccaagcgaagaggcaatcaaggcagtattagaaccagcagaaaatgactattattatttcgtagcagatacgagcactggaaatgtttatttcgctaaaacttatgaagaacatatggaattagtggaaaaatatgtaaataattcttagaaaaacaggctctagacattgatcatttttagaaaaacatttacatttgaagaaaagcgtggtaatcttttttggactatattcctcaaaagattaccttttgcggtattttatcgaaaaaaggagacgttacacatggtagagaaagtttatccaatgactctagaaggtaaagaaaaattagaaaaagaattagaagaactaaaaacagtcaaacgcggggaaatcattgaacgaatcaaaattgcccgcggtttcggagatctttccgaaaactctgaatatgaatcagcgaaagatgaacaagcatttgttgaaggaagaatcacaacaattgaaaatatgattcgttttgctcaaatcatcgataacgacggtgtagatgcagatgaggtatcaattggtaaaacagttacattcatcgaactaccagatggagaagaagaagagtacacgattgtcggaagtgctgaagcagatccgttttctggcaaaatttccaatgattctcctattgcgcaagcattgattggcaaacgtaaaaatgatgaagtaactattgctactccaggtggcgatatgttagttaaaatcgtcaaagtagaacaagcgtagtctgactgaaagatctagagagttcatcttactgatgatacactctagatctttttctctttgtgtatttcagatttcaacaaacgatcttacatctaaagtcctatagccaacagttaaaaaaataggtatgatgaaatgagaatgtgtcaggagggagaaagagcgatgaatagttcttggcgtttttttgtggtagttgaagcactactgctgttatttgctgtttggcaaatcgtaaacaatactggacttttgcttttagtgatattcggtattttcaatatatatctagctatgcgcaaacatcctcgtactaaatttcaaaattttcaattgatattaggaagtttggtcattttttttagcttagtcaacagtcctgctttatggatgatggctgtatttgccgttttatttattggactaaaaggtgtagagatttcagggatagatttaaccaaaaatgctttttggcgaaagaaacagatcatgatggtccaaacagagcaattaaaaacacataataatgagcggaaaagacagcaattattcggtaaccaacgtattggaaacgacgtctatgaatgggacgatatcaacatcgccgtcatttctggtgatactatcatagatttgggcaatacgcttttgccaaaagatgataatattgtgattgtaagaaaagggataggcagaacacggatcttagtacctttgggcgtagccatccgattagagcatgcgacattagtaggaaatgtcttgtttgaagaagagcaattttctttgaaaaatgaacaaatcaaaatctatagcagtgattatgatgaaaaccctcgtagactgaagattattactaataccttgattggagatgtcgaggtgatacgaatatgatgggaaaaatatccagagcgatgctagctgtttattcggggattgcggctttccttattattctattttcacttttcacttatttttatgccagtaatcaaagtcattggtggggagaattactgcgtgcacgtttattatatgttccgcttatcttccatttgttagctatttccttaggtgtaggattaatcgtctttctattattatcacttattcaaaagacaaaatacgggaaaatcgaagaaaagctgcgtgcactctcttctggcaattatgaatccaaattgttgcttcttccgatcccaagtgcatcggacgatttatacatcaaagatattgataaggaaatcactaaaataaaagaaaaaatgattgaagtatctagtgaattacaaattgtaacgagccgtccccaatatgtagatggacaaaccaaagaagaaattttagaattagaaagacatcgattagcccgtgagctgcatgattcagtttcgcaacaattatttgcagcaatgatgatgatgtcggcattgacggagcaagcagaaaaaagcgagacaccagaaatgtaccgcaagcagttgaaaatggtagcagagatcatcaacgcttcccagtctgagatgcgtgcgctgcttcttcatctgcgtccagtcaatttagaagagaaaagtttaaagcaaggtatcgagcagttattgaaggaattgcaaaataaaattcagatttcgctgaaatgggatgtagaagatgtaaaactatctagctccattgaggatcacttgttccgaatcgttcaagaattgttatcaaatacattaagacatgccaaagccaatgaattagaggtatatttgcataaaatagacaataatcttttattacgtattattgacgatggaacagggtttaatatgaatgaaacgaaaacgggaagttatggattgaacaatatcaaagaacgagtagctggtattggtggaacagtaaaaatcattagttttaaagggcaaggtacaagtgtagaaatcaaggtccctttgatgaaggaggcatagataaggatgataaaagttttattagtagatgaccatgaaatggtgcgcttaggcgtctcttcttatttatctatccaagaagacattgaagtaattggagaagctgaaaatggacgacaaggctatgagaaggcgatgacacttcgaccggacgtcattttaatggacttagtcatggaagaaatggatggtatcgaatcaacaaaagcaatcttaaaagattggccagaagctaaaatcattatcgtaaccagttttattgatgacgaaaaagtttatcctgccattgaagcaggcgcagcagggtatttgttgaagacttctaccgcacatgaaattgctgatgctataagggcaacgcaacgcggcgagcgagtactagaaccagaagtgacaacaaaaatgatggaaaaaatgagtcggcgaaatgagcctgtattacatgaagaactaacgaatcgggaaaatgaaattttaatgctgatttctgaagggaaaagtaatcaggaaatagcggacgaattgtttattacactgaaaacagtaaaaacacatgtttccaatatattggctaagctagaagtggaagaccgtacacaagccgctatctatgcattcaaacatggtttggtgaaataaaaacgatgataaagaggataatcaaaagctgagaaaataactattatttttcttggcttttttacaataatgatgcttgcttttgtttttgtaaaggctttgttatactgagaaaagaagatactaaaggaggaaaacggtgaaacaaaattttgcaattgtaggtcttggacgatttggcggaagtatctgccgaacactgatcgaagctggtcaagaagtactggctattgatagtaatgaagatcgggtcaatgaatatatgaatatagccactcatgctgttgtggcaaatgcacaggatgaaatgacacttcgatcattaggcataagaaatttcgatcatgtaattgtcgctattggagaagatattcaagccagtatcttagttactctgatggtaaaggaaatgggcgtaccaaatattttagcaaaagcccaaaatgagtatcatgccagagtacttgaaaagatcggagctgatcgcgtcgtccatcctgaacgagacatgggaatacggattgcgcataatttagtgtcaaagaatattttagattacctagagttgtcagataaatattctttagcagaaatccgagtatccaatcctaaatttttcaataaaacattatctgaattaaatttcagacaacgttttgacttaacagtagttgcaattcgcagagtagatcaaacggtgatcgcttcacctgcagcagatgaatatgttcgtgaaaacgataatctactagtgattggtgagacaggcgatgtggatattttagacgataagatgaatcaatagaaagcaggttgttaggatggaattaacagtaacaccaaaagcacaaaaatggtttgaatcagaaatcgatctgccagaaacttacggaatacgtttttttggaaaagtctacggcaaaacagaagttcatgatggtttttcgattgggatgtcagtggaacagcctgaacatcctgtcaagaaagtggaaatagctgggacactgttttttattgaggatgcagatgaatggttcttcaaaggatatgatttacttgttgattatgatccaaaattagaagaaccaacctatcactttaaaaaacaatagaagcaagagggtgtgacaacttgtcacaccctcttgtttaaagtaggctgattcagctatcaatatcctgcaaacaatttgacttgattggtttgaaggttatgagtagcaaggtagctttttagattagttaaaaaaatagacattaatttcttttgaaaatcaggtgtcaaacctgcaatatgggacgtgatcagtacattgtccattttccaaagcgggtgatcttgtgggagaggctcctcctcaaaaacgtctaatgccgcaaaggaaagttgctgcttgtttaatgcttgtatcaaatcttgcgttttaacagaagcgccacgaccgacattgataaatacagcttttgaatcaaagtgttcaaatatgtgttgatcaaagagtccagttgtttcctccgttagaggtaagatattgacgacgaaatctacttcaggaagaacttcctgaagttgctttaaagaaaaagttttttccattccttctgctggatgaccggatgtattgattccatagcaaatcatatccaatgctttgactttctttgcaatcatttttccaatatggccagttccaatgattaatatttttttcccttggataggttggtaatggattgaggaacctaaccatttcatttcactctgtgccctttgtgcttggaaaagaccgcgagaataacctagaatgattcctaatacgtgctcggtgatcgattcactgtggataccacttccatttgaaagtaagatatgtttttttgaaaatgcttcaagggggagttgatcaactcccgctgagatagactgtacccatttcaagttagaagaggctaatagtttttcttgatagtttgagttccaacccaaactgatttctacatttggtagatcttctggttgtaattctgtcttgaagacataaccaggcgctatagtatggatttcttcgataaattcgtcacgaaatggacgatctgcgtaaatgattctttctgacatagttaattacccgcctttctttactttaagtgtagcgcatataagaagaactttgaagtgccatgcttttttagaaattaatattgtataaataaaaaagagttgtgacaaaagatgtgtcacaactctttttccgaataaacggtgttccagaagtagcttctgccacaacctctaaaagagtttattgaagttgaaataataagttgtctgtatttctaactgatcgatatttttgaccatcctttgacagcttgagcaaaaataaagatacctgcaaaagcaataaatgcactagtgtcaaaagaagggagaaagatcatcaagagtgttgcaatgatagtcggtaacgagattgaataaatcaatgtcttcaagcaatcaaggaaagtagcttttgttagtcgaaagcgtgcatagagaaaagcagcgacattggcaaatagtaaagtgatcagcagattcaagaaactaggataaatcgaaaatagaaaggtcagggcttttacccaaatcggtatagatgcttcacttaagaaggatcgaagctgcttacctgttaaattttttaaagattcattggtgtagggaagttctaactgattattattcaataaagcagaggtagtgcctgtattgggaagagcaatgataagtttgtcttttaacatcccgacactaacaaaattccccatcaaatcagtagagatgtcctgttctgttcgttttccctctggatcaaatgtgaagataatggagtttgtttggtaaatgaatccttctttttcttcggtttgaagctgcccgttttggattgtaaaatcaggaatgcgagtagcaatcttttgcccatccaattgaatgttgtttaagacttgaaaaacttgaaaagagattggcaaagccataattatactcaaaactaaaagatagacaatggctttccaaaatgggacatttctcgcctcctttaggtctttgaatcgtataaaggaactgataattaattgttttgttgtcataagtactcctcatctagtagtgtcatcacttgcaattctagcgaagtatcaagtgaaatacaagtgctttagggaaacagctgaatgattggtgaaatatcaaaaaaatgttattcttgtctaaagactatccaatataaataaaatggaggaaggaatagtgcctacacagccacagagatcatcaaaaaaactatttggagtagtggttttgaatgcggtgatcactttatcagaatttattggagggattatgtcagggagtttgtctcttgtttcagatgctttccataaccttagtgatacattggcaattattttttcttacggggcacaaaaaatggcccgaaaagaagcaaataaaaaacgtacgtatggctaccagcgtttagaaatattgagtgctttcatcaactcattcatattgatcatattatccttgtttttaaccgttgaagcattcaagcggttcacttcaccagaaaagataaatagtcatttgatgctaacagtagcagttattggattgctcgcgaatttgttctcagtattattattacgacaagaagcagatgaaagtttgaatataaaatctagttatttgcatttgttaagtgatacactgtcttcggtaagtgtgattatcggagcaattttgatccgttttttcgatatctactggatcgatccagttattacactgatcatttcgatatatatattgatagaagcgataatggtgatcaaaaaagctgccgctattttgatacaaagtgcacctgctatcgactatgaaaaaatggaacaagaaattgaagcaatcgatggggtaaaggatgttcatcatgtccatatttggcagtatagcgaaaagataattattttcgacggacatattgattttgaagatcagctactaagcgagattgaaaagatatatcctcgtataatttctttattaaaattaaaatatggtattacacatgtgacgatccaagcagagacaaaggcaaaggatcaaaaaaaattaatttttttaaataaagatgaaagttattgaaatatagagtatgataaataagaatttttaataaggtaggttggctcatgaagcagtatcgacagttaaaaggatatttagaagcaaaaggatattgggagatactagtctatctcttttttggtggtttggctacgattgtaaattttgttagttttgctctcgcacgccaatattttgatttaagtatggccttatccaattctatttcgtggttttgttctgtattgtttgcttttgtaacgaacaaactttgggtattccattcaaaatcaccgaattttacacatgcacttattgaatgcggtaagttcttcttttaccgtatcctttcttacggattggacatgggggcaatggtattgttgatcaatgttatgaacagcaatgagtatgtggcgaaaatcatcactcaaattattgttatcctagcgaactatattttcagcaagttgtttatttttaaagaaactgaggtttttgaagaagaagtaggtcaaagtgaaaaagacgactaggcataacaattgaagaatttccttctctttgttactctttgtaatgtagacattattaagaaaacattgaggaggaatttttttatgacttacacattaccagatctaccttatgcatatgacgcattggaaccttatattgacgaagaaacgatgcatctgcatcatgataagcatcacaatacttatgtgacgaatttaaatgcagcaattgagaaatacccagaattaggcgaaaaaacaatagaagaattattatctgatatggacgctattccaacagatatcaagacagctgtacgtaacaatggtggcggacatgctaaccattcatttttctgggaaatcatggcaccaaatgctggtggcgaacctacaggagaaataaaagaagcgattaatgaagcttttggtgatttttcttcttttaaagaagaattcaaaaaagcagccgttggacgatttggttctggatgggcttggcttgtaatggaaaatggaaaattagctattacctctactgcaaatcaagattctccattgatggaaggaaagacaccaattctaggtttggacgtttgggaacatgcttattatttgaaatataaaaatgtccgaccagattatattgcagcattctggaatgttattaattgggatgaagtaaacaaacgtttcgaagcagcaaaataaccatttcctccgtcatatcagtcttaaaaataatttggaaaataaaagagcgaaagcttgctagcgttttctaaattgggtataatgttcttgcaaggttacttgcaagaacttttttggaggctatacatttatggaacacggaacggttaaatggttcaacaatgaaaaaggatttgggtttattacagtagacggcggagatgacgtatttgttcatttctcagcaattcaaggagacggcttcaagagcctagaagaaggtcaagaagtagaattcacgattgttgaaggtgcacgcggacctcaagctgctgaagtgactaaattataataatttgttgaataaagacacgacttcttagagagtcgtgtctttttgtctatttatgaagtttttagattttttggctaagtaaatgcatttgttcacttgacatgtcctaactaattatcaagcaaggaacattttcttcgttagtaatggattttaaagaaatttcagttttttggatgttgaataaaagaccatttgtgaaaccactagtatacatactcattctcatgtcaattctattactttaaaagaaaatcgttttactttgaagaggagcatatctatccattaaaagatgatggtaatgcaatcactagttcgagtcattttaatagccatgcagtgagctggaaataaaacgaatagaagatgggtttaacaaaaggaacagtcataggaagaaattttcgtgaaatcgaatgataatctgaacggtaggcaaagactgttaaaaagatgagaaaggtatgtgcgatcattttactgcacgattatttggaaaataccttgttgttcgctttttctggaaaaaatacataaaaaaagataaaacgattgcgaactgcgtgtattcggtctttcgatctttttcacggtatggtatgatagttaagaattttgagaaattttaaaaaataataatcgttacacaaaaatgttttttaaagttttcttatgattaaaaagtgaatttgctgattgaacagttatatgagacaatattttagaaaatgtgaaacagaggtgtattatgaagcgatggcaaaaagttctattaaccttgttaggggtattcgttttgctgattgccggattatcagcatacggaatcagatttatgggagaagcgagccaaacagtaaacaaaatttctaaaaactctaatcgaatatcctccaaacgttctgagagagtaagcattgatgacaaagaacctttttcggttttgctattaggtttagataccggtggattaggaagaacggaacaaggacgttctgatacgatgatggtagtaacagttaatccgaaacaaaaaaaatcaacgatcatcagtttggaccgagatatttatacgaatatcgtaggttatggaacggtagataaattaaatcatgcctatgcatttggtggtgtcgaaatggccatggattcaattgagcaactgctcgatattcctattgatcattatgtaacgatcaatttggatggcatggaagatttgatcaatgcggtcggtggcatcaaagtgaataataaaattgactttactttggatggtgtccatgtaccagtaggtgaacaaacattgaatggagaaaaaggtttagcctattctcgaatgcgacacgaagatccagaaggcgatatcggtcgacaacgtcgtcagcgggaagtagtgacgaaaatcgtcaataaagttttaagtttagatggcgtaagcaattatagaaaaattttaaaagcagttgagaacaatgtgacgacggacttagattgggatgacatgcttgatgtagcgacgaactacaccccggcgtttgaaacaatcaaacaagaccagttgcaaggcgaaggacaaatgatcaatgatatctactatcaaattttaggaaaaaatgatcttctttcgatccaaaatgaactgaagaaacaattaaatataaaaacaagcgatacattacctaatttgaaaaatgagaatgcttcaatgatgttctttgatgattcggaagatggcgattcgacaaacggtgatggatcgaatagtgaagggtacaccgattattcttcctattcagaaaacacatatgatcagtaccaagatccgaatacctattatcagcaaacagaagatacaagtcagtactatacaccaagtcaagatactcaaagttatgatccttacgctggacaggaacaaaatggttatggttatgaccagaataatgagtatggaacaacaagtgggtactagaaaaaaatagtttggttaataaagagtgccacctaaattagacaaaaaatctaacttaggtggcactttttctatgtgttaaattacaggacgtctctttttagcgcttagtttaaaaaataaattgaataattcaatagagttgcgaatagtacccataaataataaggaatcatgagccacattgccaggcgatgatgcagccacaactgatacataagcattgacaagaaaataactaaaagtgtaatatcgattgctgcaatgaaaatatttcttaaattaaaaaatagagcagaccatataaaattaaaaatgaactgaatcacaaaaagaccgacaagattgtttcgctgttttttgttgttgtgattaagtaacaaataaagagaaatacccatcaatatatacagtaaggtccacatcggcccaaatatccagctaggtggtgcaaatggtggaagttgcaaagaatagtaatattctccgggatttccgctaagcaaccctgataaaaagcctaatatgacaattcctataacacaaacccaaaaacgaatatcttttatcatcttcattttactaactcctttctataatagtagtttaccatgaaggctcacagcaagacctgtatttagtttgtgaagtaagaaaaaaattgataattgttgttattaaaaagttgaacatttgtttatatgaatgatgtttttgaaaaagatcatatgatttgattctcatgttttctatttgtacttttctcgtctacttctgttataatctgcatcttacttttttcaccttttttacttcaacataaaattataaaatcataatgtttgtgttaatgcaataaagcgtttacaatgtggttatcaaatgaaggaggtttctacatgaaaaagattagtacgttattgtttattgggttagttagtttagggttgttcggttttagcattccaggatttgcgcatggttatattacttctccaggaagccgtgcatacctaggaacatcagcagcaggaaacttaaatcaaaatgtcggaagagcacaatgggaaccgcaaagtatcgaagctaccaaaaatacattcattgatgggaaaattgctagtgcaggagtcagcggctttgagcctttagatgaacagacatctaacagatggcataaaaacatggttaatccaggaacattaaatattacttggaatttaacagcacaacatcggacaagtacttgggattactacattaccaaaccaacttggaatcctaatcaacctttgaaatttagtgattttgaattgatcacaaaaatagacgacaaagcaactgttccaccaaaaacagtcaaccaaacgatcacacttccgcaggatcgaaaaggatataatgtgattttagcagtatggaatatcagcgatacgacaaatgcattttatcaagtgatagacgtgaatatccaataataatcaaaaagggctgtgacaaaaactatgtcacaaccctttttttaaataaatagtgtcctcctgttaactcttcggtcacaagtacagtattcataaaacatgaagagctatttttgtttggctgttcttattacttgatacagggcagactttttcacaacctctttcatttagtcagcgagtctcgtcatcttcacgacaacttcacaacgtgcagtctgaggaaacatgtcgacagactgtaaatattcaatcttgaactttttacttaaatcaaccagatctctggcaagtgtagaaacattacaggaaatatatacaagtttttttggagggtatttcaataatgattggatcaatgcgttatccaaacccgtacgtggtggatctacgatgataccatcaggctgaaaaccttcattcaaccatttaggcagaacttgctctgctgtcccgacttcatatcgagtgttgtgatatcctaatctttccgcatttttttttgcatcagcgattgcttgaggaacggtatccattccccgtacttctttggcttgttttgctacacttaagccgatcgtcccaactccgcaataagcatccacgatcgtttcattaggctggacatctaatgctttaattccttcgccataaagcaattcggtctgctgaggattgagttgaaagaaggcacgaggagaaagatcgaaagtcacttcattgatttgttcttcaatggcttcttttccccataagtggatcgtttcatcccccatcacgagagacgttttttgtgcctggacattttgcatgattgaaacaacttcgggcagtcgttcattgatctcacggatcattgcgtttttttgcgggaattttttactgcgagtaataaaaacaacttgtaactccccagttttgacaccgattctaaccatgattgtgcggaagattccactgtttgtccgttcatcatagatgggtgcatcaaatttattcaatagttgaacaacagtattcattactttttgtgttcgaggttcttgaaccaagcagtctgttatagggactaactgatgagagtttgcttcgtataaaccagcttcaattttttgagtctgcttattttttcgtaactgaaattgtgctttgtttctataatgccaaggctcatccatcccgatcgtcggcaaaagttgataagatcgaaagcctgctggtttgaatttttccaatgcttgcaaaagcagatcctttttaaaatccaattgggcttgataagctaagtgttgtaattgacagccaccgcattcatagtaaacaggacatggtgccactacgcgatctttgcttgtttttttgacttttattaattctccttctgcatagcgaggggttgctttcgtgattttcactagtacttcttcttttggtagtgcatatggaacaaatatgatcaaccgtttgaaataaccgattccttcaccatttatgcctaaacgcttgattttcaaaggaaccgtttgtccagttttgacaattgtttctgccataagtatctcccttttttcttttttctgtggtttattctaacatataatacctgattacggggattttctgtggtatgatagagaatatatgttcgaggaggatgtttatgttaaccgttacgagaatcagtaaaggcaaaggccctttctatcgcgtagatttatctgaaggagaagctttacaagtatctgaagatgtattagtacgctatcgattattaaaaggacgggaattagacgaagaaactatccaagagatcaagaagagtagcggagctgatttcggttttcacctagcaatgaattacttaagttatcagttgcgatcggaaaaagaaatccgaacatacttaaaagaaaaggaaatccttcaagaagatcgaaataaaatcgtagcccgcttaaaagaattggaccttgtcgatgatttggtctatggggaaagttatgtgcgcacgaatatacgcttaagtgacaaaggaccaaagaaattagcgcagcagatgcagcaaaaaggtttgaaacctgaaatcattgaacaagcgctcagccaatatacatttgaagaccaagttcaaaatgcacatcagacagccgaaaaagcgtttggaaaaaatcacggaaaaagccaaaaagaattattgagaaaaatccaacaaacattgatgacgaaaggcttttctcaagaagtgatccaacaagcgatggctgatcttccgcaagaagcagatcaagaaatagaatatgattatttagtcaaacaaggagataaactatggcgaagaaatttaagatttgaacctaaaaaaagaaatctaaaagtaaagcaaagcttatatcaaaaaggatttgatttggatatgatccagcgattcattacggaaaaggaagaggaaagtgaataaagaatgggaaaaatggacagataaagaaacaaaagaatttcaagatcagttcattcaatggtatgaacaagaaaaaagaaacctgccttggcgctataatcgtgatccttatcgtatctggatctctgagatcatgcttcagcaaaccagagtagacacagtgatcgattatttttatcgtttcatggaatggtttcctacaattgaagagttagcaaatgctccagaagaaaagcttttaaaagcatgggagggccttggttattactcaagagcccgaaacatccaagctgctgctaaacagatcatgtctgaatttgacggaaaaatgccgcaaacgcctgaagaaatcagctcattgaaaggaataggcccctatacgacaggagcgattgcaagtatcgcatttggacttccagaacccgcagttgacggcaacgtgatgcgagtagtcagcagattgttttgcattgaagcagacatcgcaaaagcttctagcaggaaaatctttgatgaagcgatgcggaaaatcattgatgaaaagcatccaggcgaattcaaccaagcaatgatggatctaggttcagctatctgtacaccaacttatccaaagtgtgagacttgtccgatccaagccttttgtttagctaacaaacgaggaatccaaacgagttttcctgtaaaaacaaaaaaagcaaagccaaaagacgtttattatatcagtgcggctcttcaaaatcattctggagcgtattattttgaagaaagagatagccaaaaattgctggcgaatatgtggacatttccaatgatggaagtgacacaagaggagtatgagcgattgaaaaaagaatgggaaacaaagccagaaatcgatctgtttgatgacctagtagcagaagaagagcaaaatctcccatttgaaaagcaggaactctttgtttggcagacacgacatttaggagaagttactcatatttttagtcatctgaaatggcatgttctccttttttacggacgggcaaccgagggagcagaacaagaatttaccgagaacaaaacttcgaagtggttgaagcctgatgcatttgattcggtcgtttttcctaaggtccaaatgaaactggtagatcagttagagaaaaatcgaaacaaaaggaatcctttctaggcaaagctcatttttattgatataataattatgatgtcggtgtaatgaacacccaaacacaaagcacaaaatgctgcttaaggaagggttgctatgggagttccaaaagaaggagagtttgtgacgatccaaagttacaagcacgacggcaaattgcatcgaacgtggcgagataccatggtattaaaaacaagcgaacactctatgatcggcgtgaatgatcacacattagtcactgaatctgatggacgccgatgggtaacgcgcgaaccagcgattgtttattttcataaaaaatactggttcaatgtaatagcaatgatcagagaaaagggggtttcctattattgtaatctagcttcaccttttttgctggacgatgaggccttgaaatatatcgactatgacttggatatcaaggtatttcctgacggcgagaaacgactattggatgtcgatgaatatgagatgcacagcaaaatgatgaattatcctaacgatattgacttcatcctaaaagaaaatgtgaagattctggttgactggatcaataatggagatggcccgttctcggaaggctatattgatatttggtataaccgttacaagcaattgtcgcgtaagtaaacacaaaaaagaacagtaagccagtgagagatttttctcaaaagcttgctgttttttgcttttttcgaaataaatttttataaagtctttttcatataaatatgaggcatgccagcatcttcaaaaggatcgccgtaagctgtatatcctagtttttcgtaaaaagtttcagctgtggactgtgcccctaataaaatcgtattatagccttgattcttagcaaagttttctgcttcttcaatcagtatttttcctaacccttggtgtctgtattcagaaagaatcgccatccgctgtaatttcatttttccgttttctaaaggcaaaagacgtacagttccttgcggttcttttttatctgagtacaggacgaagtggatacaatgggcttcatctttgtctatttctcgagacaaaggcacaccctgttcgactacaaaaacttgatgcctgatccgtacagcatctaagtaaatattgctcattgtatcttttgtttgtacaactttcatggtctagccaccttcctttcgtatagtatactggaaaataaaacaaataaaaagtatggcaagttttcaaaaataaaaaaagaataaaagaatttttaacgaatataatatatactagtaagaaagaaaggaggaaatctattgtttgaaaaacttagacagtctaaactaatgttttggtcgcttgaattattaatcatagctgcattgatcatgatttcatcagaaataaactttattttcgaaccgatcgggacatttttttccacgttatttgcacctgtactgattgcaggctttctttactatttattgaatcctattgtcaagctgttgatgaaagcaaaaatcaaaagaatatgggctgtcgcaattgtgctgctccttttagttgcagcaattatttggattttacttagtgtcatcccaagtctagtacagcaaatttcctcattggcatctaatatgcctgatttcatcaaacaggtagaaagctggttgaaagaggtagccgaattgcctttgttcaaggaagtagatattaataaatattttgagcaattagacatttcttacgggacaatcattcagcaattccttagtggagtatccaatagtttaggttcgatcgttggaacgatcgcttcggcaaccgtagtaatcattacagcaccattcatcttgttctatatgttgaaagacggagaaaaactagtgccaaacatccaacagtttttcccagaaaaaagaagaaaccaaattgtggagttattggggcaactgaataaaacattggctaattacattagcggacaagcaatcgaatgtttattcgttggtaccttcacatttttaggatatatggtaattggtgtggattatgctttcttatttggggtcattgcgggattgacaaacctaatcccatatttaggaccttatctaggactagcacctgcatttctagtaacagtcttcaatgatccggtaaaagcattactttgttgtgtggttgtgctaatcgtccaacagttggatgggaatatcatttatcctaatgtaattgggaaatcactgaaaatccatccattaacgatcattatcgttcttctagtagctggaaatattgccggattgcttggtatcttcttaggtgttcctttttacgcaatctgcaagacgatcatttcctatataatcaaaatcgtcaaagaagacaagcaaaatgaaaacaagaagaaaattgctacgacctcgtaggtagttttagtacacttgtttttattgcaaagaaaattgctttgtgataccattttaacgtggctatagtgccacgtttttttctatcgtaaactaaaaattaattttataaggagagaatgcgattatgaatgctgaccctgagagtcagtcgctgttagcgcagattttattattgatcgttttgacattgatcaatgcttttttagcagcttccgaaattgctgttgtttcgatcaataagaatcgaatcgagcaaaaagctgatgaaggagatgtgaaatctcaaaagcttttaaaaatattgcagaatccaaataatttcctatcgacaatccaagtaggaatcactttggtcaacattttgtctggtgcttcactagctaatactttatcggaacggttagctccggtattaggtggcggcacagcggcaaaaaatattgcaaatatcattgtgctggctattttgacctatgtatcgattgtttttggagaattgtaccctaaacgtattgctttaaataaatcagaagaagtcgcaaagttcacttcagggctgatacgcttgattggtgtagtagctaagcccttcgtctggctgctttctgcttccacaagtttattggcgcgtatcacgccgatgacttttgatgatgaagattcaaaaatgaccagagatgaaatgcgttatatgcttgaaaacgaaggcgtattgaataatgaagaattagaaatgctccaaggggttttttctcttgatacgaaagttgcccgagaagtcatggtcccacgaacggatgcatttatgattgatatcaacgacactgtggaagaaaatgtgaataaagttttatccgaaaactattcaagaatccctgtttataacgaagacaaagataaagtagtcggaatccttcatacaaagaatttactaaaagctgcccataaattcggctttgataatttagatatcaagaaaatcatgcaggagcctttattcgttcctgaaacggtctttattgatgatctgttatatgaaatgaaaaagacgcagaatcagatggctattttattagatgaatatggcggcgtcgttgggttagcaacactagaagaccttttagaagaaatcgtcggagaaatcgatgatgaatcagatgaagttgagaatctttatgaaaaaatcgatgaacacgaatatatcatccaaggacgtatgctgattgatgagttcaatgaagcttttgacagcgatctgcatatgagtgatgtagatacgatggctggttatttgattacagcattaggcatgattccggatgaaggcgaaaagttatcgtttgatgtcgataatattacgctggtttctgaagaaatggaaggttctcgaatccttaaaatccgtgtcatttttcatgatccggaagaaacagaagcggaacctgaagaagaacgaagatacttcagaaaagaattcgaagatgacgagccaagaagataattggaaacttggttatgaaagacgtgttgcttgaataaacaagcaacacgtcttttcttttagtcagctgacaaaaaaatatttgactcttatggtttggtggctttttcattcgctgaatccatgctatactgattcagttgtagtagttgacaaaggttgtgaaaaagctatcctgcattaagtaataagagcagccaagcaaaaacagcttctcgtgtttttggcttgggtgggcttattgctgataggctgtctctagaacgccgtttactcggaaaaagagactgctacacggcttttgtcacagccctatatgaaattgtctttctttaagagatcggacaatctgtgcctagagaaaatataaataattgaatggaagaaatggagttaggttatgaataatccagaattaaagcaacaagtggacaatcgcagaacttttgcgatcatttcccatccggatgctgggaaaacaacgattacagaacaattactattgtttggtggggctatccgtcaagccgggaccgtaaaaggcaaaaaaacaggtaattttgccaaatcagactggatggaaatcgagaaacaacgtgggatttctgttactagttctgttatgcagtttgattatcaagggaaacgagtaaatatcttggatacaccaggacatgaagatttttctgaagatacttatcgtactttgatggccgtggatagtgcggttatggtaatcgatagtgcaaaagggatcgaagcacagacaaagaaattattccaagttgtaaaaaaacgtggcatcccgatatttacttttatcaacaaactagatcgtgatggtcgtgaaccattggaattgttagaagaattagaagagctattagatatcgaatcttatccgatgaattggccaatcggtatgggtaaagggctagaaggtctttatgatatctaccataatcgtgtagagttttatcgtccggaaaattatcaggatgaacgattagtagaattggatgaagatggactgcttcccgaaaatcatcctctaactgaaaattccttatatgaacaagtcttagaagaagtagaactaatcaaagaggctggagatgcatttaatcaagaaaaaattgctcgtggcgatcagacaccagtattttttggttctgcattgactaacttcggtgtacagacttttttagagactttcgttgaattggcaccagctccttatggacacaaaacacaagatgatcagatggtaagtccttatgaggaagaattttcaggtttcgtattcaagatccaagcaaatatgaatccagcccatcgtgaccgaatcgcttttgtccgaatctgttctggaacattcgaacgaggaatggatgtctgtttggaacgtacaaataaaaaactgaaattaagcaatgtcacacaatttatggcagattcgagagaaaacgtcgaaaaagcagtagcaggcgatatcatcggtgtatatgatacaggtaattatcagattggggatacattgttcgaaggaaaactaaaagttgcttatgaagaactcccttcatttactccagagctatttatgaaagtgactgcaaaaaatgtcatgaagcaaaaatccttccacaaaggaatctatcaattagttcaagaaggagcgattcagctttataaaacatatctaacggaagaatatatcattggagctgttggtcagctacaattcgaagtattccaatatcgtatgttaaatgagtataacgccgaagtaatcatgtctccaatgggacacaaaatcgctcgctggatcgatccagaagatttggatgagaagatgagttcaagccgcaatatcttggctcgtgaccgtttcgaccaaccattgttcttattcgagaaccaatttgcagaacgctggtttgcggataaatatcctaatgtaaaattaaaaagtttgatgtaaagaagtcttgacaagctgccctgcatcaagtaataagaatagccaaacaaaaacagcttctcatattttgtttagagccgtgacggattttccgtgacggctctttttactatttaaaatcatagaaatgtctaatcaaaaaaatataaaaattattttgcgtacatatgattaaagaaaggagagtgtgacacatggaaacagaatggcaaagacgtgaaagaaaaaaacggaaaaaagaagagatgttacaattatgtcaattattagatgtaaaagactgggacaaaaacgagcagattgcacaaaaagtacgatcaatcatccataaagaggaaaaagttaaaaataaagacacgcgtagaactgaaaatgaaaagagaaaagtacaaaagaaaagagaaaaatcaaaaagctagaaagaaaaacatactaagattagaggggaacatcattgacgaatgatgttctcctctattttttcttctagtctacacaccttaatttttctgtctagttaattgtagcctatccattatctcacaatataatccaaatgtctttctatttaaaaatcaaagtaaaacttttcaaatatacagaagtataactatgtgaaacatcctttcattaatccataaaaggatacataaaaatgccactcatttgagtggcaatgaagaaaagctttagcttgtataatactcttcaaaaaattctaacacagaacgattcaaatggctacattaatgtaccctgtaggactcgagcctacgaccggacggttatgagccgtctgctctaaccaactgagctaagggtactggttgttgccacataaagccataaacaatcaaccagtagaatgtgtggcaacaaacctgttatcgcatatcttggagtgtgactatttatgagtgatagtgaagatatgcgacgacaccactattttatcgaatgatttttatagttttcaatataattatgtactgcccctcatcgaggggcttttttcatcgttgtggaatattcaaataccaacgcttgtcatgaaaatcttgtgctccgcttttagtgttcccttttggatcattcgttgcccgcatcatgacgtatactttcttattaggaaaattacgcatattgaaagatacatgataaccaacatttcctaaagtattataagcttgatttacgtctggtctataaatcccatcagctcttactctagctagttcttttccagtattgtagtccataatgaaaatatactcgtatttataattagcaatgtgccatccagctacatgcaagtttgcgttttcgatttctccaaactgatcaatgtgtgcgtagttcgttccatctgttaaagtcggattagctgcaccagctcgtgttggatcaatgacaggcttgttttcagaagttgtcggattttcatcgataaatccatgagctaaatcatatgctagtttttctttacttacgcccatttcagaaagataaccgtaaggatctgtatgatcaccccaaatattttgtgttacccataaatgtgatttgattcctggttggttataaggagtgtctaatgttaatggaataccatattttattgctgaatctcttgccaattcaacatatgctttatagttcttttcaaaagttgctttatcatgtgtgtgttgtaactcaatctgcacaggactgttggcattagcatacgaaccagccccatactgcacataaccaggttgtccaacttggtaaacaattccgccatcacccacaatgtaagcagtgtaagcactagtccatgaacgttgcatatactgcgcttcattgcgccctgttgctgtttcattagccgtttcatgcagtaaaatgtactgattatttgctacttgtgagctaccttcgtttgggcccaaattaaattcattgttaatcgtataggcaaacccattaattggcaataaaaaaagagccgttaacaggctcatcgcagtaatagtaattttctttttcatttgtttcctcctatttttttaaattataagccgacacaccagtaataacgcctaaaaatgttgctactgcattgatagtgagtactgtcatatctgttccattccatccatacgcttttcctaacgtggctactaaaacagatgtagctggtaaaactgttaaaaccgtccatttaatgacttgataatacttatcgggtaaaatcatttcttctcacctcctttacaatttagtcaagaaatagccaatgatcgtaatgcctaaaccgatcatgtaaccccacgaccatttattattggctttcatttctttgatatcttccgcattattaagcgcaatagaatatgcctgatccgctctatcttttgcgctttccgctttttcgcgtaatgattcgtaattatccagtttcgtttcaatacgcactaaacgttctaccacgtcttgtattgcttcgtctttcaactaactagcctcctttcattgcaaaataaaaaacaccctctattgagcgtgttggtagcaaaattagtattctatacaggttttacttttaaaatttattaatctaaccaataggaaaacaaatctaaataacaatatttaacatccttgccactgtcattccctatatataaagttcctttaccagtaacagctagtctacatgatgttgtaaacaagcttgttgctccaagtcccattttagtaccagaaggaatcaactcggtaggtaaagttgaagcgttatgttgctgtccttgactcggtaaagttccagctgtggtacttattgcaccattaaaaactacgtttcgatgtccattgaccagattgactctatattgtggagttgtcccgtctgcccccgtgtagccattctccagtggtaaagttttccattcacctaatacgtataaattattctctatctcatcaaccctactttttgtatcctctatagcggtcgcattagcgttcgcttttgtttgagcatccttagccgtggtatctacttcattaattgaagcagtcaactgcgaattaatctccgatactttcccatcggtataattgtttgctttaccagtaatttcagaaattttaacatctgtagcaagattgtcttcgacatattctggtgctagatcccagacgtaatcttttggattgtttgagtctcgcataccgattcctcggtatttatattgctcaatattaggagttcgggtgtcgcctttttcaatttttaaccattttatggtacatgaacctaaagaagtatttggcgtttgaaaaagatataccccttttgcgttttcccctagctgagttattgacacagtggcgacccatgtatcaaccaatccttcaactggtttaaagtcactaaattgtttttgagctaaataaacccgaatagtttgtgaggcaggcttagtcgcccctatcgtcacagtataagtttcacctaaaacaaaatcctctagtgcattttttgaatagattccctcgctactacttgtgattggaaatttaactgtaggatcagcaatgttctcccccaaagccaccttactcaaataatacggtgcatcgagtagatttggctggtacggggtggcttggtcgccttcttcgattttgatgtttttcaacctaactttaccagacggtttaagatttcgaatgtctctaactaatggataccattcatttggtgtgtcagaggtgtattttaccgtttgtgttccgataagcttctgccatttattcaattcatttttaggtactgtcgctgtctgcaaaacaacgttaccaccaggcaagtatgcgtgttgtaggcgtattccagacggatcgccagtgaagcccgtttctaacatgatttcacaactaatcgtatactgtttcccttctatcaccgccgtttgcgctcttgtagcgtacttcgatagttgatttgtgccatctaaggtaaacacaatttcatcaccatcatccgcgactgttgcgccagtacctgaagaaaaacttgaagcattaagtttagcgctaaggttcggattcccactataatcatagtccccgaagtcgatgctgttactgtacatgacttgcaagttacctaatttagaaatttcttctttcagagcatctaacttgtcttgtagcgttttagcttgaccagttaaatcagtaatctgttgatttaagctatccactctacctttaatttcagccataaaagcatcaaaagtttcgttatactttcgaatcaactcttccaattgcgaaacgtattcatcggcttggccttgcgaaatgtcagacactcctagtgagaaaaaaatgatgtcttgcgttgttaaaatttgattaccttttctatattctacgtagcagtgtttataatatcctgcttcactcataaatgtgccatcaagagaaaatgtgacttcttcactagttacgctagttgcaacactatctacataacggttagatggtgttgttccttttaaagtaaatgttccgccactcgtatccatctgcaagccatttaaaaatggtttaacagtcaccgtaattcctttgtcaccttgacgagccataatagctttggtgtagtttaattctttgctgaaatctaaagccaaattatataaactgctagccatttatatacctccttgctaaaattcattttggtcgtattcgtgcacattataatcatggtcatcaagttctagacgttgatgctcaaaaccttttctgtgtgctactaaattccaagaaaataatacattaggtgtatcagtttcaattacaaaatactctggtgtagtttctgttaccgcgaattgacataatttattaggtgttaagaatacatgatacaaacaaagcgtaactgtttctgcataaatagggtcaattggcacattaacaatgcaatcttttcctactaaagcttccccataatcggcaaaataattttctggtgtttcataggcatttaatagtctttgaccataatgttctgtagagacactggcatttttagtaccaccagtaacactaaaaccagtagatcgaacgttagctatcgttaacttaccattatacttgtgagataactctaccccaatgctatggtaaccattaacatttgccatgttcgatggtacaccagtaccatcatttctgctacctgccatcaaatcaaatgatgtagacgtattaacaccaaatgtaccatcattaaaactaagtaaatacgctggaaatcttgcatcacccttactaacggtaaacccttgtgctttatctaataattggaatctgatatttgacgttgttgtacttccactggtaaagttttctggtttttgtttaaaatatacaaccccatcactgtttcttttccaagaaatatccccatttttgatttctgtagtaaaatctgtaccttgactggttattgtaccccctgtaattgtagaacctttaatcgttaccccttcaatattaatagcctttaatacaccagacgtaataaaactagcgttaaacacgccatctaacgtccatgctgtttcatatgttccattaataccagttttagaaaaaccaataccagcattgttgatttgtaaaacattccttgcggtattcttatctggcgtgtccataatcaaaatacgactaggtgcttctttaggatctaataaaacatacccaccatcttgaccagtaatcatatcagtttgatgatctacaatatcattgattaaatcgctgatttcgccaccatttttcaattgatcaatggcatcattaatcaaattgcttacattattctctgtgttttctaagaagtttgttttgacgtttcctacaactaatttatcgtatgagttggttagaacattaaacgtatattccacaattcttgctgacatattcacttttaactgtggatgatacacatctactccatcacccatcgaaactttttccagatcaacaaatttttcataacctctttgatgcctcaatggtactaattcaatcgaaccactcacttgtggtttttgtttatctatgtttgttttcaaccagtctttagcagcttcccttaatgtggctacatcagtcgctttgtctttaaaatcaacaaaagaaacatatccagcaggataatcatccacgtaatccgtgaaaataacttcttctggtagagtgatctcgtcttctccttctgacgaactgctaatgaatggataaactccaactaaaacactttgagcatctatctctaagtcgagaccagttaagtttttagtataaatcgctttgattttatgatccgtacctagccttttttcatgacgtaatgtgttattatctttaagaaattccccatgaaatcgatctagaatagacccctcttttccaccaaagaattctaaaaaattcgctttttctatcttcacattagcaagcgtatctactaatgatgtgaaagaaaactgcgagggaataactggtttcgctaaagcttttgcgttttgccatgcctgagcagcagtgatcttttctgttccgctgtcatatttattcaacaccgattttcttatatcattgaaaataggttcagcttttacttctatcgtatttcctattacggaagtctttgcataataaatccgtaaacgttgctttgctcgattttcatctacatagcactgaataatacgtccttctataatcaagtctgcattagttccgcttattggataagtaccctgaaatatctcggctccgtttagtttattgctaacagtagctgttaaccagtctgacaaagcgcctaaaccttgcgtatcatataaatgttcagctaaattattcgcgtcgtttttatcgtaaatagttattaaattatcgatcatctatttcacctaccttaacccattacgataaatttgtattttgctcaaaccagtacaattaaaataattaatatccacttgcaatgtcggatattgcatggtcttcattttgttggaccgatctaaaatatctccgtccgattgctcttcgtagcaaagcatcaaatcactatcaataactatgtcagttcccactactaagccttcaaaattaaacacataatcatttaagatgaattggcatgaagtagctgaaggagtgatgataatctttggaaaactttcttctaaactattattcagcaagttaaatgactgtggtttatctacggttattggtacgtcttcttgaactcttgcgaatggtttcgcagtgatattcacatcgaactctccccattcaacgatatcgttttctgcatccccaatatcgatagtctggataacataatagacgttgggatcatcagagaattctaatttctttgcataatttaaccaatgacgcatgatataaaacgattgcttgaacgcttgatggtcttccacatcctctaaatagttatagtgcaatgtaaacgacatgtcttcaaacgagtaatcttgtactaagccacctaaccttcctaaaacagaagtctcaactctctgcctttttggagaaggtatggttggtctttccgctaaagccaatttatgcaaataatcaggaaatccatcgattatagaatgtatacaatcagtcattttttcacatcctttttaatactaaaaaaacaggagaaatactctcctgtttaacgccatgccgaagcattatcattttgaacttttgtaatgctatcaatgatttgttgagttgtttgcttcatagtaacttcatctgcgttaccatcaattgtgaaattgaattcgtagttgttcacaggttgaatcgtttgtgccctagatgaaactgatgtgctactcaagatacgatcaccaatttcttgcagcacagatcttttcaaaggtaaaactgcttcaggtcctgcttcaccgacaccgataatattcggagaattaaacacactacctttcgcataccaatcaacacccaacgttgggatttttcccttcaatggattgaattccccactcaatttaaaatgtggtaacggaatatgtggtatcgaaatattcagattatcaaagatgccactgattttatctctaatccaatcaatcggagcgctaacagtctttttgataccttcccaaatgttagcaattgtacttttaacattattgaatatgtcggaaacaatacctgttagattggaccaaccgcttgaaattgcattttttccatcgtttactttggagctaatagtgcttgtaattccattccaaagattcaaagcagtgtttttgataccgttccaaattccgctgatccacgaagatatactattccaaacactttgaatggcacttttagctgcgtttatagcattgcttatactactagtcacactattccagatatttgatgctgtagagctgattgaattccaaattccacctaaccaactagatacagttgaccaaatattttgaattactgtagcagctgcttgtaccaagctagtgattgtattcttgatactgttccaaatactagaagctgttgcactaattgaattccaaatatttgaagccgtagtactaatagatgtccatataccattccaccatgccactactggatcaaatatagtatggaatgtagttacaattccgttccaagcgatgcttatccattgtgtcatagtatcccaagtatttttaaggaaatcagaaataggtgtccaaacagcttgccaagctgcgcctaataactgtccagctacatcaaaaatacccacgataatattaataccagcttgaatcaatgacgttattaatgtccatggtatttgaacaattcctacaatgtctgcccaaataatcgaccatacttctttgactccgttccaaatatttgaaacccaatcaacgaatgtttgccaagtttcttggactccttgccagatgttggaagctccttcaactaatccgctccatagctctccaaaccaatcagaaactccttgccaaatatcttgaacccaatctacaaatccagaccaggtttctttaactccatcccaaactgatgaggcaccttcttttatactttcccaagtaccacccaaccaatcagtgaatttactccacattcccttaaaccagtcagtaattgcgccccagttttttataattgctataactccagcaatagcagtaataactgctcctattattaatgtagtaggaccacctagagccatgaagccaactattattggcattaataaagtaaatgcagcagtcaaaccgccaatcgctacggcataatcctgtactggttgtggaagattattaaacgcatcagccatctttcctagaaaatcaattactggttcgagtgcatctatgattgtgttgcctataggagctaatgaatcctttaattcagctattttcccgttcaactcttgcaacggagtagtagaatcttcattcattttttgtgcagatccactaacatcatcaaatgtatggttaacatcagttaaagattggacaactttcatcgcattatcttcgccaagcgcagaccaaattgtcgaagctttatttaattggtcgtattgaccatccatattgctaaaatcttgaatcatggaattaataacgtctttttgtgttcctccgccatttttccactcttcaaaagcttttctagtactttcactaaacatatccatgttttgctcaaatcgaccatctgttaacgatattcccatttccttaactaagtcattgactttatcaaggttataagcacccgcatctaaaccattttgaagcattccgaacgtttcatcagctgaatatcccatttgactccataattggctatattctgccatattgtcgcctaattcgttcgttttatctaaaccgttttgagtacccgaaaccattaaatccattgcatcttgagcactcaagccgaaattgaccattaagccatttacaccacgtaacgtttcatccatatcagcgcccatggtgttttctaggaccatagcttgttccgtgatattttgtaaatcttgattatttaaatcgcctaaattacgctttaccaaaatcaatgcatctgtggactgatctaacgattctccaaaacctttataataaatgtctctggctacattcgttaattcttcagcctcttgtttagacaaaccaaaattagcttgtatcttactctgggaactacctacactgttagcagagtccactgcttgtttccctaattctgtaagcttatcgccaatgtcgcttaaaacgtcagaagcttccattaaattattcatatctattttgcttccgatatcgtccaagttagttgtatctacatttttagcagcttgtcctaactcttcaaattcacgttcagcatcattaagcttcgcttccatctgcattgcttctgtggatgtagcgccaaattcagactgtgtagcttctaactgtcgtcttaggatatctatcgttttctccgcattttcagattgttgagaaacatattcttgggctttcgctaatttctcggcttcagaagctgattgaccagcagttgcttgccattttttgtattcggattcaatcagagaagcactagcttgaacatttttttgttcactatccaactgttgcattgtagactcgtacgtctgtatttcgccttttgcttgagctagtgcattactcgttttatcaatttcgtttgacaaacgttgttgcgctgtttgttgattaatcagttctctttcaagtttctgaacttcggtggaattttctccataatattttttcgcattggctaaacgttggctagttacttcaactttttgactttgtaattcatactgcttctctaaagaagataatttacttcctaacttgtctgattcagaaccagtctgttgtaattgagcttgttctagttttaattctgctctatttttagttaattcagcgctgatttcttttaacgtagatttcaatccgtcatcgttagctatgaaagttacttctgcttctgttctctttttagccattttttacctcctttctttaatttttttgggattgatttattgcgtagttcttccatccttcataagcgctcttgttgtaagccatttgtaaaatgtcatctaaacagatatcgcttaaaactaaatctgaaggcatagaaaaaacgtcggtcaacatcgaatagacatcgacccacgtttcaactaagagctttggcatttttacttttgaagctttttttccttatttgctttttcgaattctttttgataggcatctcgtgcttgtttgaacatcatcaattgataaatatagctggcagtagccatatcaaaatcccatttatcaataaattcatcgaatgaaatataatcagtcatgttcgcttggcggtaagcaatatacacagcctttgcaccttgaataacagaaatatccatggatccttttcccacagtcatttttgcaaactcgtctgtgttaaaatctctattgatcatcaataatttcttgatattcagtttaggttctaaattcaaaattgttccatcgtttagttcaatttttgagtaatcttcgttcattttgctacctccgttttatgtttaagcttgagtcgttgtagtagtggttgttgaactctttttaatcacatcagcagatagattcgtcatccattgatctgttaagtcttcttcaagttctgcaacaattgcttcatgatagaatttaccaaattcatcttgcataacttttgtttctagttctaacgcagctacttcatccgcaccattttcaatagagaatgttaatcctgtattcgaagtgcatgctaacataccaactaacttgctattttcttcgaagtcatccacgatctctgcagcaagtgagaaatcttcgcctacggaatcaggaccgtaagagtaaatgcctggtttaatacgttcatcttgtttcaatccattgaaacgtcgataaacttccatcggtacatgtgcagtaattgttaccgtcatattgattggtttagattttgattttacttctgtcgctccacattttttaaccaccgtttgcatttctgtttcgccatctaattgtccgttacaatctgttgcgattgcattttctgcgttcttaaaattaaaagcaattcgtttgatactcacgttatcgaacgttgttactacagttgttgttttagccattgttgttccccctatttatttaatttatcgaattgacgaatcagaagttctgtaattggatcaagtgcaagacctaatcctcttctcataaattcgtctggctgatttcttttagaagtacctatccccaaatcaggatattttaaatactcaaattttcttgtaggtctaatgatgaaacccaaattaatatattgagtcttaagtggacgactattttttgcgtgttggtgtcctcttcttaaatctgcttcagaaacaggaattttttccgtaatcctatccactgcaatatctgaaccttttgatttcaatgcttcgttaatcagtcgttcgctctcgcttgaatagcgttccatccgcacaagaagttcatcatgtccatttatttttagctcccaactatttttagccatgacaatcactcttcaataatcgtctaaacgtaaataccaattgatcgatatagcgatcttgattttctagttttaaatggttgggatccattctctgaaaacgaatcgaacgattttgaatcaatgaaataatatctagtgaatctcctgttaaatcttctctattttctgaatagaaagttagatatagattttgacccacgctatattttggttcagtgatcatttctatttctcctgtttcgagaatgaagtaattaaaatcatcaggtagctcatcctcgccaacagagtcttgaaagagttttagcttaaaatgttcttctaaggaagttttgatagcagaaatttgcttatttaaacgttctttttctttagaattatcaatcaccatattcacccacactttcaagataaaaatagatataaaaattatcgtaatcggcatagataacgttgtaacgcatactattgattacgataaaatattgatctttattaaatttcttggcgattggatgaaatggtgtctttactttcttagttaatttcgatcccatcgcatccatagctgttatatcgcgatctctcatggaaagatttctaaattttaaagaagtgatttctgtatcttctacaccaatcttttttcctaattcatttctttttgtggtttgcgtcaaaatctttaaccatccatcgttgaacgtttcttcgagtctacgattattcgccattcccatcacctgcaatatattcttgtagcgcataatgttgaatgaaacctaataactcactagcgaaattttgttcaaactcatctaaagcacgattccagtcgtatctacatctttcgattagcaatccgtattctaagctttcaggagaaaaagaaagagttgtactcactttactttgaagataaacggcatttttagctatcatctttttaattgactcatcttcttcattccaggtaacgtaaatattatccttcacagctgttagcaattcttcagtcacttgttcaggcgtcatctaaccaccgccttaattgctttaacatatgcgtaagagcattttttcttgtttacaaatgataaatcttcatcaaaaggtgtggaagtcacgtatctccctttgaaaaataaatcttcatcatttgttgttactccagcattatgcaagatttttacttctttaaatttttctattggatcagtagcaaaacaaaagtttaattcctcgtgaactttaggaccaatattgaaatacattatgttccaaagctgtgcccacatctcggctgtccaaatctgtacatttgttttttgccctctaaggtagcgatatagccgattagaatccagataaacctttttccaataattcgctttaggacggttaataacccactgtgcgcctcctgaattagtgtttatagtttccaaagattctactgtaacatttacaatatttgccatatcttttagaatattttctccgttttcacagcttctaatataatcaagacttagataactacagcagtcgctacaataccaaacatcatctttagaaggcaatttgcgcaaattaattcttttattgaaaatgacatccgaatcgatatagaaatatcggtcgttctcacgcgaatgatcttcttctaaatatttccaccataaatatggtttaatcgaaggaatatactctttgtcgtcccgcagatcatcgtacacatgaacttcaacgccatattccttctcaaaaaaaataggaatctgatcatcgtgtctgctgaaaagcaatatgatgtctttgattcctagtttcttcagattagttaaacaaacttcaagctcccatttaaaccgattgattgccggctgacaaagaatatacttcattctgatcacctacgcttgtgttgtagttgttgtggttgttggttttgtagttgtagtagtagttcccaaagcgctaatatctaatacaatgaaactatcattacgtttaggttgtccgtttgcatattgtttagctagataaatgcgttcgtcttcaacaaaatggtattcatctgaagcttcaatttttagcgtagatcctacacccatgaagtaatctgaagctaccccaataactgcttttccttctggcacagcagttgactgcaagtctgaaactggtactggcaatacttgtacatattctccattagcagttagtacagttttagctgggaaaactttagaccagtaatctgttggattcacaattaggaccacatcagaaggatttacattacgataaatcggatcatctacgccttcgatattgaattttgatagtcgtgccatcaaatcgcccatagttgcagcatctaaagctgtaataggttctgctgttttttcagcatattctccgctagtttgtttgctcatgtcacgcatcattccaactggcatatctttaccagtaccatcaacaattgcttgttctaatgcaattctcaacgattcaactaaaacagtacgaacataacgatctaaccatactggacctaagtcaagcattgccttacatacagggatataacctgatagcttgaactgcttcatgttaattacgtcaaagccattatctaaaactcttttaacagcttcgcacagtttaccccaccatgctggattgactccacgtgacacaatccattctgttacaccagttgtgttaacaaaagtaattttttgcaatagtggatgagattgttctagatcttcaaatacgcgttcaaatacagtagctggtactaattcttcaacccctgcaaaaccttcgttattcaccacttcgttatagaattttgtttcttgcgtagttaacacacgctgaccacgattcattaatactaattgatcttgattttttgctgttgcttcttctaaaattttatcctgaatttccttagataagcttaccatagctgcgctaaaagattcttcgttaccatctttaaaagccttcatcaattggtcgcttgcagctgttacaccttttaaatttttaactgtcattattttgcatctccttgtccaaatgttttatttaatgctgctgtaaatgcagcaattttttctgctcttttttcttcaacttcattcaaaatttcttcaacgctttgttcttttttagcttcagtacctgagctattttctgcatcgataatttcatcgaccaatccataactcaaagctgtttctgcatccataaacgattctttttcaagaagttcttgcaatgcttcatctgtgccattgaatcgtgttttatatgaagcctttaccgatttatcaattgattccagttggtcagcaatcgtgcgaaaatcatcgacatttccttctccgtatgtggaagcgcggtgaatcatcaattgtgcattgttgtagatttttatagtatcgccagccattgcgataattgaagcagcactagcggctaagccgttaatcacaacgttaacttttgctttatttgacttaagtaagttcccaatagcaatcccttgaaatacatctccaccgtttgaattaatcactacttcaatttcttcttgatcacctagactatccaaaatatttttgattcccttgtcagtattaccttcaaagaaccaactagaaccaataaatccctgaataaaaatttgcggtactgtgccttcattctttactgctagaaatgttttcattgttgtcattcgcctcacctcctttcgatacttgttggttgtttttagttataaatatttcatctgccatcgccttatcagagtgatcatttccaacgcgttctcttccttcgttgattgtaaataccccatttctaatgcctacatcaatagcgtcaaccaaatctttgaagctagtaatcttgatcatagttgtatccacacgtacaaaattccctgacaagtattcttctgcttcatagagactagcgttaaacgcatcctgaataagttcagcaatcggtatgatttcgaacattaaaaaagcgtccacttgatccgataacccactcatatctccctttagtaggtttttcggaacgtgaaacgctgctgctgtcatctcaaagatgtcgtctattaagttttttatatctcttgaattgctttggaagtttccgctgaaatcttctaatgtgtactcattttgtaattgaaataccgcacctgcattatcagcttccataaaagccttaaattgtgatgtcatcattttattgatttgatcttgtgttgtattgtcttgcgatcggaataaattccctttcagtacgtatctacgagcgttagaacgcttgtaaacattcatggcactagaaatgagtttcccatacgcttgataatacgcatcgactagttgcctaatttgttgatctgcgtattttatatagataacatcactttctagaaattctctatcaagaactatgttattaatttgcacttgagaaaacacatcatctttcaatgcatattctgtgacatcccaactatccgcaataaatatttcgctagaattattagacggagaaacgatcaatacttcattgtagaatattaatctcctgatcagtttttttctaaattctgttgcattatttttcttattaggagctacattcagcctatagtaaagatcattctttttattttttccatcttcatatgacttgaattccgctttgctcatcgcatttgcgatcaaatcaatacaagtttcaatcgcaaattttcgatacacaaaatcaacttgcaatttacaaaagtattcttctaaaggaactgttgctttttttgtgaagtatcctatcgccttttgaaaaatccccactttctcacctcctttcaagttagaatactagaggagtaaatccagttcctgtattttctactgaactatttgtgactgttacaggagcagaatcataaatatcatctaaaaaattcaaaccatgaaggaatgaaaaaaagccatccgtttttctagtttcaggttctattttttcatagcgtatatttccattagaaatatgctcttcatatacattcatgcaataccaacgcataatcgcatcgtcaccaaaaaataaacgttgattaataaaaaggtcatcaactagatcttttaacataccatgtgtaacagatccgcttcgaacaatttccacagtaaaacctgcttcttctaaagcgggcttcaatatttttgcacggtacatatccatagcaatttttttaatataatatttgttactcatttcaagaaaccaacctacaatataatcagcttctatattttttccatgaacgatttgtgattttccttgatctatagaaatatctataacctctcgttttatgttctgtaatcgaagagctgattcgtggataaaagtatgttgggtaaaatacacatctttatcatattttcctagcaaaccaacgctcgcaaaatctcgtctatcagcaaaatcgactgtccctatcacttcatccattttttcagggaattctttttcttttgtatgaagaacatcatcatatgaagctacagcaaatcgtgtatcttccattggtctgttcattcgtttcgtcatgaacgtaagtcttaaaccagcattacgttgcatttgagagtattcttgaaacattttccgttttagatctgcattgtaattaatagttggacaagctttttcccacatgtcaggatcatcaacttcattatcattatccaagcgacaaataaatggaaacaaactagaaaattctgctccatccttatcaattccaagttctccagaaagaatcatttttgattcttctataatgtcatcaagtggtccacctcgaacgtgaccattagttgtatcataaaattctctataatctcgaattttaccaccaccagaagtagctacatttatcattgaataatcttcattttcgtgaatttcatcaaagcggtttgctcctggtcgtttaccatcttttgttctagcgtttgccgtgttataacgaagcttgctatttgtagcgatattttgaataacttccttcgtagctttaaatacttttttatctaaatcaggatgatctttaattactttaaatacatcatcaaaactagtctttgcttggctttcattattggcatagatatcaatatcataatttttaataccgtgttttgcagtcagcaagaaaaaattgttccaagaagcaaaaccagttttaccattaccacgtcccattaatgaaagatatctattgaacacaagcgttttatcttttttccatcggactccataaataaaacattgtagaaatttttcccacggaattaattcaaatggaaagtattgtgctggtatattgattgaatcctctaccatttgcttatcgaagtaaatatcttctctagtaaagactctttcttctagatacttttttagcaataattgctctttgcataccttgatagtgccttcttctatagctttgaaccaattttcaatatgcttataactcaggaattgattcatttgcttcacctaccaattcaggagtaatggcaagtttatccaacatcaatcccatttgtttgttgacagaaacaagcaacgctactgattcattctttttaccattctccaatctaataccgttctcggatatatcttcttccagtgatatcgccgtttcccataaactgatataacgatcaacattatctaaaaatggctcaatatttgttttctgactttccaattggcttattaaagagcggcgtaatttttctctgtagcgattttgagacaattcgtttttaaacattttagccctcctttcatgataaagttcgaaaaaatctcttttcctgatagtcccctccgtttcatcacccccaaaaaatttgcgatttattttaagggggggttatctcaccatcggaatgaaagcttcagcgaagtcaatgtaataattaatctcttcaatgctatatccgaaaacattttttattctttcaacattattatctttatttaacgcttctcttacttggttcactttgtatttgctacaacagttatctgataacagatccctgatgcctacatagcgaacgtatatcaaacgtttaattaatccctgagtataagatgaatactcttcaatcttttctgtatcatactctctgccattgtcattgatgatcatgcacttaccacctttcacttgcgtcgaagttagcaaagctttctatcttcttctcttgtttatctagtgctgtaagatatctgccatgaacttcattatgatgttcaacacataaacaaataagattatctaaatctaaagctaagtcaggtctatccttgacttcctttatatgatgaacgttctctactctatgatacttacctagtcttctacactcttggcattcatagtgatctcgtttcatcgctttctccctaagccttcgccatttaggagactggtagaacttaaccaaacgatcttctcttatcaactgtaatagccatctatagaattcctcggtcatgccccgtctcctttcgcaatcttatttaatgcttagctattcttttgccatacaatggaataacttcattgctttcctttcgtttgtatgtattactctgtattggtcttctaaactcatgtactttttcgccattacctttatgaacggtgattacttcatacttctgttctaagtattgtggtctatacattgtcgtgcctcctttgtgcaaaataaaaagaccactcaaagagtgatctaatatgtaatagcaacctacacacagacaagtctaatacttcctgcgcctacccacttcctcaatacctcggttgctagcggttttactttcgggatcttgtaccgcaaacccaaagacactggagtggaatcgcaccacacacgagaacttaccaggctctcacgaggctactcgccatttaccgttgcgtcttctacttccgccacagcgataaaattttattgtgaaaataaatactaagcgtataattttatttatcagcgagtggtccgctgaaatagacgaaaggagcaattcgtatgccatattacattgctaaccaaaatcaagatgacaaaggtcgccacgaggtgcaccgaagtacatgtcatcgtctccctgagaaaaagaaccaagtagagttcggttactattctaactgtacagaagcaatacgagcaatcaaaacattaaatccttcttcaaaatttgatggctgttactactgttgccctaattgccacagaggttgagtaccatgaggagcagtatcatctgcttctctatttttttaaatttcgatatttctctactgaacgatactcaatagtttcttccaaatgctgcttgtaagctttgccaaccgcagcaagttcattaatttccattttttgctgagtgattacactgatcaattgatcacgatccatattctcatatgctgcaactaatccattttccataatgtgcctcctcgaaataatattgatagacaacagtgtacgaacaattctgcaagagttgagttcacatccttgttagtattcactgctgtctatcgaagcttaattaaacgatgagggagatttcctcccttacattttattttgtctcagacctatcactaatctttcgacactatcataatacaacattgaataggtaagtgattggtataaaaaaggtataaaatggaaaccaaatgggtaataaaagggtataaaaaatgtaaaaactggctacttgaaagcaaccagttctaacgatgaagcaaattgaatgataatcttgtttgattctagcttgacagattcttcactcgtgttatttctttgagcagttacataaatgggcagaccattgatataacgatcatagaatatcttcttgcgcctttcagtcacatcaggcttatgcggatgctgtatcgctgaatagcctcgaacaaacaatttatgcagatactcaaattcttcttgtgcttcttctttatcgatcagcattctttctgcttcaaatatatgatcagctgtagaagatggaaccaaggaataagatgctgtcacttttggttctcgaggttgacctatcctacatctagctgacagatatgctgaaagaaaaacaccaacattatgttttgtgcgatccatatccacatcttttgcctctggtgtctcatacttctttacatcgaaaagtaccatccattgattcctccatttatgatataataattgtgtcagaattattaattaaggtcggaggaatccggctttttttatacccatgcttatgctaagcttttcaagtagcgaggttgcactcgttacccatatacatgttgagctatctggcggaaaacagatggctcactatttcaatattctgctaaggacagccagtggtcggctgtcttttttatattttaatgagaagccttacttatttttttatctttattacgaaaaatgatattatctattgataataaagcgtataggagatggttgagtgactatgtggagcatgctgttattttggattcccgtttgtattggtatcgtcgcattttgttactttgtcaaacactctagaacaaataagctcctcatgttatcttttttacctatagtattttttattgtacaaattgttaaatatacctatattgaatcgcaagaaatattcattttttatgtggtaggtttatttatctctgtggtctttttcataatgatactttcctatttttataaaaaataaatttttctcttagaagtacattttttcgctgtttatatagccttcatatccactaatcgaacaactgcaatattcgctttgctcttcgctagctctttgtcacagtccatcgtattctcaatacgaataactgctgaatgattgtagacgtgttctacatatccacgaaatggatagatgaacccttctgcttcgcagcgaaccacgtcaccgactttgacttttggtttcttacgtgttttagggttctttgtcggcatatctagcattaaaccgccgataccatgactactagcgtaaaatccgtcttttagtttcattatgcttcctccaattttatagataatgttttcgcagatggtgattctacttttcttaactgcgctatatctttgtttgctgatcttttatcaaaatactcctgagctctcctcttgttttttgtaaaaacaggtttgctatcattccagtgatgaaaataaactttcttaaacgaaccatctttgtaatcgaacagataaaatgctattttgaacattcattccgcttccactggcacagcaaacggccagtagttttcatttgctgatttaatcgtaagttcatctaattttgcgacaaaaccttttctaggttcttttgtatgaaatattctagtttcatcacttgtgatctcataatgtagatacaaatactttgttttaagctccgctgcctcttcatcccaaacttcatatggtagtctcacataatacaacggctctttctcgacctcgtagccgtctatccaagcacgagcaactaattcttgatggtctgcttcaaataaccaatcttcatcttctgttattcttttatattgattaacaccatactcatacgaacctgatagacaactaattaaatcagctttttctttacatagttctatccaatccgccacaaacttcggcacaactgacttctgcggttcttctagttgttctaaatcacgaataaaattagcaaataaatcttgtctcgaagcattcacagatggatgtttccaatcttttggttcttcagcatattttgttttatatctttcaatcaattcttgtttattcatcgctgttcctccaataactcgctattctcgtatatatttccggtgacttcatattcgtatcccatcttttggtggctgaatattctatattccattccactaattaatgatttacaaactaatccggaatgaaactcggattcttgtacaaccgttttttcattaactaaatgatcaaaaccattacttacattaaccagaactacatccccttcaaatatctccacaccattcttatctttcagtcctatggattgcatgagttcgtacttgtctatcattccccacatgccgcttcctaaatttactagaggagcaataaagcctgtttcatcatctattgtccagtctacgtttttgtcattatgcggatagtacatttcattttcttctgttgaatatgatctaaacttcggtatcatttgctgccctccttcaaaatagaagccatttctgatttttttaaactagtccttatttcctcagaccaactatcaaaaacagtctgaatataggctacgagtatttttcgattttggcttaaagcaatatacggatcaatcaaagcaacttctgcgtgtagacgataataagcaatacaatctatttctaaaaatctcaaacgatcaatagcatcattaatcataaaatctgtaacgttttctgctgtatttaaaccatctgcatattcaggcaggacttcattattgatgaactcagccacatcttttggacataaatcagtcagttcttgttgtgtatagttcatttgctgtcctccttctgtaactcaccgtaaattgaacatctacggcgaatggcttttactctgcgttcattttcgatggtgggatggattttgtacgctctttttgccattttcaattgatttctagcacctcttaatgcatctgaatagatttcttttggcatcatcattcgctgtcctccaaatcactcgacttcacgaatacaccatctaccattttccctgttcgtcctttgatttcgttgtacgccatttctaaacactcttgtacgtttgtccctttttgcatggaaaggataatcagcgtgacgataacgtctcctacgctatctttaaatagctcatcattacttcttgccattgctgaagcgatttctccgaattcctcagctactttcaaaaattgtgcttttggatctgcctggtttaatcccttatctttagcccactgctctacttttgtgattagttcgtccattattcattctcctttatatatttaagttggataatacaacttgtaacaaatgaagctaatgttaaaattgtgccgattggtgttaaaaaaccgctttttatcgtattaattaatatagctacaaatatcgttatatagaataaaaagtgaattgacgctaacattgaattaaacatctagtcctcctcgaaatactcattcagtatctctctatacttttctacaaatttgaaacgatcttgatgaagtttcttgctccaatttgtttgccgatccagctcacgcatctgatcgaaccctttttgaatttcgttgtaataaaatagaggagaacatcattcgtcaatgatgttcccctctaatcttagtatgtttttcaagataaagtcaaaactggtacgcttttgtttctacttattttttgattatctttcagtttctcgttctttagctcacaatatcgatttgttcttttaattcttcgattttcggagacaatatattgcgacgttctaattcatgcaccatgaagtttacggctttaagcagctctttccttgtgatgattcctttgaaagcccgttcttctgtgacaaccggtaaaaaaggcgaatcaactaacaaatggagtacttcttctagttcccaattttcatcaatcgtcggaacatccgtttctgttacatcagcaactgttagtccttctaacggatccatgctgattgtttgcaagtcaatcattttattgaccacatctgataaacttactagtcctacaaagtgatcatcttttcctaatacaggaatcttggaataaccgaccttcgataagacaagtaaaccatgggataatggatgatgatacataacatttgccacattttctgcaggaatcaaaaacgtttcctgattttccagcagcatttctcttactataggtccaatcatctgatggcctccatttctatttcattcaacactactattttaccgaaaccggatgcaaaattcacaaaataaagcttatttttattaaaaattagagtttttttattcagcgctctctcgaaaaagaaaaggccaactcttcaactgcctgatgggcacggttatagtattgaacagaaatttggtcctctaaactttcaataagagcatatgatgggatttggatcgggcctctaggttgagaaatgcttccaggattcaaaaacaggattttctgatccatctcacagcctatttgatgggtatgaccaaaaaacaccatatcggcatttgcagctcgagcttcgattgctaactgtgtcaaaccaaatcgaacattcgataaatggccatgagtcatgaatactgtatcctgaccagtttggatcacttttttctgttcgaatcctggtccataatcacaattaccttgaaccacttggaatgtatcccataatgggtcagaagcttctaattccgaatcaccacaatggaaaaagatgtccacttcagaacgataacgatctactaagtcaacgaggatatctctgtctccatgattatcacttactactaaataccgcatctatctctctccttccagccattgtttccactcggcactcaattttttcattgcttgagcccgatgactgatcttgtttttttcttcgctcgataattctgctgctgtttgtttcttaccttctgggataaataaaggatcatacccaaagccattttcgccagatggtatacgggctactcgaccgggccattccgcttctactacgaggctgtcttttttgggtgccgcgaatactaatgtacaatggaattgtgctgttcttttttcatccggcacatctgtcaattcatataataatttggcgttattccccgcatcacttttttgttcccctgcaaaacgtgcagaatagattcctggcataccgcctaacgcatccactttcaaacctgaatcatctgctaagactggttgatcaagcaattgtgcaatcgtttctgcttttaatcgggcattttcttcaaatgtgctgccagtttcttccacatctggcaattcaggatagtcaagtaatgtttttacatgatatcccgcttctttgaacatatttcgaaactcttctgcttttcctggatttcttgtcgcaatgataattgtttttgtttcttctatccgctcattatcttgagcaaattctgttagcaaagcatgtttttgctctttgatcaaatcttcaatcgcgttttttccaaaaaagagcatttcattcaactgttctccatcaaacgttgcttcttctccagttccttgaatctccacgaattttcctgattctgtcatcacgagattcatatctacaagcgctgcggaatcttcttgatagtccaaatctgtcacgcaagtcccatccggcaagatccctacgctaactgcagcaagatgctctttgattggatcttctgacaattccttttctcttaaaagcttttcaattgctagtctcaacgcgacgaatgccccagtgatgctagctgttctagttccgccatccgcttggatcacatcgcagtctatgatgatactacgctctcccagcttttccaagtctattactgcacgcaaggagcgaccaataagacgctggatttccattgttctaccagaaagttttcctttgttgctttctctacgatttctcgtactcgttgctcgaggtagcatactgtattcagctgttacccaccctgttcctgtttctctcaaaaagggaggtacagaatcctctactgttgcagaacaaataactgttgtatcaccaaaacggatcacaaccgatccctctggatatttgaaaacatttgtttgaagctccagtttacgaagctcttgggcttttctcccgtcatgacgcatccttattttcctcccaattcaatatggtctacatttaggtgtccgattccaagccagtcttcggctatttcttggaaaagtttagcagatcctgttgtataaaactgacataatgtccgtccattttgcggtgaattgctcaaatggaaataatcgagtagcatagatacttcacctactgtttctgctccagaatcgatcagttgaacattttcacccactacattttgaatgatagggcgtaataatggataatgggtgcatcccaaaatcaatgtatcgatttttttagtcgttaacggagctaatgtttctgccacgattttttttgccacagatgaatggtattcattactttcgacaactgaaacaaatttgggacaagcaagacttgtcacagtcaattctggcactttctctttcagtgctttttcataagcttgactttttaccgtaccaatcgtaccgataatgccaacttgtttattttgtgttttttttactgctgctcttgtaccgggaaggatcacaccgatgactggaatagaaagagcagctttgatttcttctaaagcaaccgcagttgcggtattgcaggcaatcaccagcatcttgattccttgctccaccagataatccgtcatttcccaagtatactggattacctgttccgcaggtctaggaccatacgggcagcgtgctgtgtctcctacaaataaaatattttcattcggtaattgtttcagggcttcttttactacagttaagccgccaacacctgaatcaataaatccgatagggcgattatctgtcaatcgtatcatcctttttttcaataaattctatcttccctattgtgtactttttagcgtgaattttcaagtgctctcacttgcttaaaacaatcaaaatctctttttttcgaatggaaagaggaaaagcggttgtgacttagtttgccacaaccgctaaaagaatcatctattaataactgtaccgtctcttttccaagtaaccggaaagcagagaaagcgcgtaacacaccacgaagtacataagtgtcatgatgatgaacattggaagcacataattggtattctgtccataaataatacgtgcctgatgagaaagttcaggtaaagaaatgattactgctaatgatgtatctttgatcagtgaaatcaattggctcacaattgccgggatcatcgatttgaatgcttgcggcaaaacgatcgtccgcatcgtttctacataagtcagtcccgttgacaatcctgcctccatctgccctttcggaacagcattaagtccagctcggaaaatttccgacagcatagctgattcaaagatcgtcaatgctgcaacagcagaccagaagatgttcatctggatgccaatctgaggcaaagcaaaataagtgaagaaaatgatcaataataatggaagatttcgtatgatatcgatcacaataccaaggattttggacaagaaagggatattcgcaaaacgaatcacacctgtcagaccaccaatcaagaaactgaaaatgatcgaaaacaatgaaacttcaacagtaacctttaatccttccaataaaaaacggacattcatccatgaaaaagcgccgctaaaatccatgtatttcccctccttctatgaacgaaccgcccattttttctcaagataaaccattaagtaagataacggcagcgtgataactaagtaaaataacccaacgatgatatacgtatcgaaggtattgaatgtttcactggcaatcaaatctccttgatacatcaaatccaaaccagctacgattgctaaaatagacgagtttttcacaagattaataaattggttgcctaatggcggaataacgattttgaatgcttggggcaaaacaatataacgcataatttctgaataggtaaatccagaagacaatcctgcttctgtttggccttttggtacagtttgaatccctgaacgtactgtttcagcaataaaagcggatgtatagatagtcaagccaatcgtccctgcttggaatccgtctagattaaaccaataaataggtacgacaacataaaaaaacatcacgatgatcaataatggaatgtttctaaaaaattctacatatgcctttgctaaggcacttactactttattctttgataattggaagattgccatcaacgttccgataatcaaactaaacacaagtgctaagacactcgaaaacaatgtgatcttgaacccgtcgacaaagattggtccataagtctgtatcaattcgctcattgcctctccccccttactctacttttccttcagtttcgtttggaaaccatttttgatagattttatcgtatgtgccatctgcatgcatttcctctagcgcttggttaacagctttcaagaagttttcttgtcctttgttgatcgcaattccataaggttcattagtaaacgttccgccgactaactcgtactctggattttcatctgcaatccctaacaagatcgcattatccgtagtcatcgcgtctccctggccagattgtaacgcagtaaatgcttctgcataattttccaattccagaatgtttgcatctggtgcatgctgtcggatattcgcagccgacgtagaacctttgactgctagaactgttgtagaagcattcaaatcatctacacttttgatttggcttcccttctttaccaacaaagcttggccagcatcgaaatagacatctgaaaaatcgacttgtttttttcgttcatctgtgatcgtcatcgtcgcaataatcgcatcgatgtttccgtttttcaataacgggatccgcgttttagaagtgacttcaacaaattccgcttttccattctcaccaaggatcttttcagtgattgcttttgcaatatctacatcaaatccttgtacggttctgctctcaatatccatcattccaaataatcgagtatcatatttgacaccccagctgatttcattggtagatttgcttcgctctaaaatatcttcatttgccaacccatttcctttacatccggctagtgcaagaaaagcaatgcctaaaaggaaaatcaggcgtatttttttaaacctgcgcatctttttcctcctatcaatgattgataactttactgataaattgctgtgctcggacttcatttggattttcgaaaaagtctctcacatttctgctatcttccaatacttctccgtcagccatgaagatgacacgatccgcaacttctttggcaaagcccatttcatgcgtcacgacaatcattgacatgccgtcatgcgccaattttttcatgacgtccaatacatcaccaatcatttccggatccaaagcagaagtaggttcatcaaacagcagcatctcaggattcatcgctaaacctctggcgattgccacccgttgctgttgtccaccggataacatggaaggataagaatctttcttatctaacatattgacagttttcagaaatttctccgcgtttttgactgcagttgcctggtcttgctttaacactttgattggtgctaatgtaatattttccagaacggttttattaggatacaaattgaaatgctggaaaaccatgccgatattctttcggacttctgtcaactttgtctttttatcatgcaagtcagtatcattaattagtagcttacctgaagaaatcgtctctaatccattgatacagcgaagcatcgtgctctttcctgaaccagaaggaccaatgacaacgacaacttctcctttctcgaattcgagattgatattttttaatgcgtggaacttgccataatatttatccacgtgatcaaatttaatcattgccatagaattacactcccattattatttagtaagatttcttttaaagatgtataataaaatacattatatctgatagtttagtaatttgtaaagtttcttagaacgtttattctcccataaatatttctttcatttctaatctattagttattttatcctctttccttgttttttccttaggaactgttgtttcttgtcaggaaaaacggtaagatattaagtgctcagacttacaaatcgtaaagaggtgtcttttttgaaaaatattattttaacgggagatcgaccaactgggaagctgcatttagggcattacgtcggttctctaaaaacccgagtggctatgcaagcagacgaagacaaccaactgtttgtcatgattgctgacatgcaagcactgaccgataatgctaaaaatcctgagaaggtttcatcaaatgtcttgcaagttgctttagactatttagccgtgggattagatcctgcaaaatctactttatttatccaatcacaaattccggaattagctgagttaaccatgtattatttgaacttagtcagcgtaggacgcgttcggcgcaatccgactgtcaaaacagaaatcgaacaaaagaaattcggtgaaagcgtgcctacaggattctttatctatcctgtttctcaagcagctgatatcactgcattcaaagcgaatctcgtacctgttggcgaggatcaaaaaccaatgttagagcagacacaggaaatcgtacaaagcttcaatcatacatatggtgaagtcttggtggaaccgaaaggcgtattcccaccaaaaggaatgggtaggttacctggaatcgatggaaatggcaaaatgagtaaatcgttaggaaacggtatttatatctccgatcctgccgatgtcttacagaaaaaagttatgagtatgtatactgatccaaaccacatccatgtacaagatcctggacaagtagaagggaatatggtcttcacctacttggatgtattcggaacagataaagaagcaattgaagaaatgaaagctcattaccgccgcggcggacttggtgatgtaaagatcaaacgatacctcattgatgtattggaagctgaatttgcaccgatccgcgcacgccgagaagaattggaaaaagatccttcagctgttatggaaatcttgcgtaaaggtagtgaagaagctgctaaagtagctgcacaaacactttctgaagtaaaatcagcaatgggaatcaattacttccattaatacatcggtgaatccatcttagtgacatcattaccaaacacaaaaaaccgaacaatagttgagtagctgcttacttgcatgcgtacgctctctatcgttcggttttttgatgttcaaaagcagaatcagagactttcactttagttgaaataattggccagttcttagtccgtgacgacttgtttgtcgatcacttgattggtttcttcaagaagtgtcgtatactgcttttcatagttggtcagttttttcaatgcatcttcgtattcattgattggctgagtggcgaccacagcttcagtgacattccctttttcaagtgcggatattttgttcagctatcgtcaaagaagggccaaaagctgtgtccccctcatttttagtggtagtttttttatagattttctaatattccttttcttactaaatagttcctttattctccatatttaatgaagtgtttaagatatttatataaggtaaacaaagaatatactatcgctattacaattactggaatgattaaaaatctagtttgaatatcaaaaaaacactaaaatataaacgattagtaaaaagcctcctacaaaaaaagcaatagatgaagctcctaatgcacctttttttgaacttcaatcggtttatctttaaaagtattcccagcaactattccataccatttgcctcttctaagttgaataccaacgattattaataaaagaccaagaacaactaacatgaacaccactaccacctcctttaatctctgaagtagccacgtgcaaaacgtctgaaattcaattaatgatacactaagaaaaaatggttgggattaccacctcggccatttttccatattcagcagattaaatgtcatgaattcttatccaataaacctcttattagtatatagccaaaactgttctttgaaaattagcgataaaaataatgattttcctgttcatttaaaatctaattacttgtgtaataaaactctcccttttcaatttcatcttctcttttttatcatacttacatagcagtgttattgatagtctttcactgtgaatacgacggctcgatacctacctatttttctgattttagaaatttatggaatctacctgaaaaataaaaaagagcagaaccgaagatggatctgctcaagtatctattctatatatataagtgttttaaaaaaattttttaaaagcatggacgactgataactattttgcttctaacttttaacgaatacttgctccaagtgtttctgtcaaagcttttgttaccttatccattgctttattgatttcttcatctgtcaatgttgcttcaggattgacgaatgtcaggctataagccatggatttatgtcctttttcgatgttttctccttgatagacatcaaataattggatatctgttaaaaatcttccggcagcagaatggatcacttctgttaattcctgatttgtcacagtttcttttacaagcaaagcgatatctcggctgactgctgggaattttgtcactgcttcaaaaacgatttctttttgggcagcttccactacagcagataaatcaaactcagcaacatatgtttctggaatatcataacttttggcaattgtcggatgcacttgaccgacaaaaccgatgaattgttcgccaaggtaaatcgcagctgttcttccaggatgcatttcttttatttctgtcaccgtttgataatggatatcttcatggatacctagttgttcaaataagttttctaaaagacctttgatggtgaaaaagtctacgttttgtgctttcgtctgccaatctttttcttcccaaataccagaaatagcgatggctgcatgttttatttcttgtggcagatgtgtgcgcggatcattttcttggaagaatacccgaccaatttcatataaagcaatctctgtattttttcgagcagtgttataactgatatcatctaatagtccgctgatcaaattcattcgtaatacagaacgttcttcgctcattggccagtccaaacgtgtaatattactttcttttataacaaactgtcttgatttttcttctgttgtcaatgcataactgatggcttcgctcaatccgcttccttcaaagattgtacgaattttacgagtagtttcttgttcttttgacaagcttccagcaaccgtttctccacttggaagagtagatggcaactgatcgtatccataaatacgagcaacttcttcgataatgtctgcttcgatttggatatcccatcgtcttggtggtacgactacggaataaacatgatccttttcttcatagctaaatccaagtgcttcaaaaatctcatttacttctttaacgacaagagatgttcctaaatattgattgatgcgttcaagtgaaatcttcactgatacgtcttctgctttgatctctgaacctttgaccgcaccttgtagaacttccccacctgcaagagaaacgatcattgctgcagcaacctcactggcttctccaacagttgcatggttgatccctttttcaaagcgtgcagaagattcgctacgcaaattaaattgttttgctgtacgacggatcgaaattggatcaaacaaagcagattccagtgccactgttgttgtttcattcgtaatctctgaatctaatccacccatgacaccagccaaagcaactggttctttgccattagtgatgacaagattgtcagttgtcaattcccgagattctccatctaacgtgactaatgtctcattttcttttgcatgacggacaaggatctcatttgatttcaatttgtcgtagtcaaatgcatgtagtggttgtccgaataaaagcaaaatatagttcgtcacatctactacattgttgattgggcggatgccttcattcatcaaaagattttgcagccattgaggacttggttggatgtttactccttcaatgatgcggatttgataggcaggaacgacttctttatcttcaactgtcactttgattctatcgctagcaagttgtgatgattctactaatttctcgtcatcaaatgtaggcgtctgacgatagattgccccaacttcataagctacgccacgcattgacaatgcatctgcacgatttggtgtgatagacaattcaatgatcgaatcatccatatctaaataagaaaaaactggatcgccatttacagcttcttgtggcatataatagataccttcagcgtattctttcggtataacactgtctgaatagccaatttcttgtaacgagcaaatcatgccatttgatacttgaccacgcattttcccttttttgatcttcacatttccagcaatccgtgagttaggaagcgcaacgattactttgattccgaccttcacattaggcgctccgcaaacgatttgagacagttcgtcttcaccaatatcgacttgacaaatagaaaggtgatcagaatctggatgtggtacacattccttgacttcaccgacaacgatttttttcaagccttcttctggaaccgtgattccctcgacttcgattcctgttacagacattttatccgctaattcttttggtgttacattcgataaatccacataacgattaagccatttatatgaaactaacatcttcttactcccccttgaactgacttaagaaacgtaagtcattttgatagaaattacggatatcattcactccataccgcaacatagctacgcggtctggtccaaggccgaaagcaaagcctgaatattcttctggatcgattcctgacatcttcaacacattcgggtgcaccatgccagctcctaaaatctcgatccatccagtgtatttacatacgttacaaccggcaccaccacatttgaaacagctgacatctacttctactgatggctccgtaaatgggaaataacttggacgcaaacggatttcacgatcttccccaaacatttttttcattacgacttctaatgttcctttaaggtcgcccatcgtgatgtttttatcaacaactagcccttcaatttgatggaactgatggctgtgggtcgcatcatctgtatctctgcggaaaacttttcctggcgaaatcattcgtagagcacccttagagaaatcatgcttttccattgtccgcgcttggactggtgaagtatgtgtccgaatcaatatctcgtctgaaatatagaaagtatcttgcatgtcccttgccggatggtcttttggcaggttcatccgttcgaaattgtaatggtcagactctacttcgtaaccttctacgatctgataccccatacctacaaaaatatcttcaatttcttccatgatttgcgtcacgatatgacgtgtaccatgctttacttttctaccaggcaatgtcacgtctactgtttcttttgccaaagctgcatttaacgcttcttcttctaatacttgtttttttcgctctatttcttctgtcaaaaggtctcggatctcatttgcgaaacttccgacttttggacgttcttctggacttaggtctttcatcccacgcaatacttctgtgatcggtcctttttttcctaacgtttcaacacgtatttgatttaattcttttaaatcttgtgccgccgtgattttgacgattgtttcttctttcaagctctctaattgtgcttgtaaagacatgtgcttgttcctcctttaaattccaaatacaaaacaaaaaggcctcattcctgttaaggaacgaggtcttcgcgttaccatcctaatttgcggataaataaacttacaccgcactcttacttcgttaacgacagttgccggtctgataatgatcagacgaactcggaaagtgaacttcatttttcaaacacaggatctgttttcagtctgtgacagatctccctgaactggtttagccaaactactctttttcgtcatcgttcttttacttattcgtatggactatagtttacaagattttttttacaaaatcaaccgcattcttcctctgtgacccatttttcgctccaaacttgtatttgatgcattgctttttgcaagtctgctcctttttcagtcaagagatattctgaacggcttttttcactacaggcaatgtttcgagtgactattccttctttttctaattccttcaagcgttcgaccaatacccgatcactaaccatcgggatttttgccgcaagctcgacaaagcgttgcggaccattttcgagtagtacatcgataatcaatccgttccatttttttcctaaaatagagaacgttttttcaaatttaggacacaaaacgaattctgtctgtgttagctccatcatactcacctcttcccagagtatagcataatccttacaaaacataagtcaagtttgctcaattataattatttattaatgtttatgattcgtttcacccgaagtaaaattaggaaaacattttctacaggtttattcagtgcttctgtcattgcttgttggtaaagtcttagctgtccttgatatttttggacgatcgcgtctatttctgctggatcatccggatgtaaaatgaaatctgttttaaaatcatagatatggagatgatctttttcttctaagtatccatcgacgattccgtggatcaatagctcatcttcctgatttggatagtcttgaaatacttcatcagcagaaagcagcatggaaaaaggttgttcccgttttacgttttctttgttggcaatcaattgttgcccaagttctgtttgaaagaaccatataatagaagaaacatctactttttttgcgaccttttcgtctattaaccgtttctttactaattcctgcaacttttgattgatgctctctgtagttggcatttctaatggcagcaattgcagtaaagcatgggtagctgttccaacagcagctgccgacacttgccgatctttttgtaaaaattttggttctgctagttgttcttgcgtataacggaattgacgagatgctgcctttgtctgactgctttccagagtcaaacgtgattcttgtgtatcatctggatcttcgaataatcgtttgatctcagatacagattgataacttgtggtttgcgaagaagcctgataaggatattcataggctagacgtttttgtaacgaatctgctaatacagtttccttttctttcatctgctcatctaagttaaccagttctttttcagcaagcaactgtctttgttcaatgattgtctgctgattcatccatgaaatagaaaactgtgcatttgaatcttgaaggagagaagtcgaaacttcttcctctaagtatttctgcatttcaggatgacggatcaatccgtaaccaatccaattcatcaagctgcttctgcccttcaaacgtagcgcaggatcaaaaaccaactcctcatgatcagctgcttcagaccacgtttggatcatttgctctttatttttataggaaccgacaatgaaaagcttttgttctgcccgagtcaatcctacatacaatttacgcatttcttccgacaacaatttgttttgctttgccaatttgatggcttgaaacggtaacgtatcatataacacccgtgtttcaggatccatatagcgaatacctgctccaagtttttcttcaaaagcataccgattgcgcaagtcttgtaagttgaattctttcgtcatatctaacaaaaatacaactggaaattccaagcctttacttgcatggattgtcattacgcgaacagcattatcttctattgaaatgactggttctgctaagtctttatctttttcttgcattttttcaatgaaacgcacgaactgatataatcctctgaaagaactttgctcgtatgctttggcacgatcgaccaatgcataaagattggcttgtctctgtgctcctgctggcaaaccgaccacatactctagatatcccgtctcataatagatatcccatagcaagtcagtgatcgaagaacggcgagcaagttctcgccaatgatctagttgtttgccaaaatgttccaacttagccgctaattcatcttcgtttgatgcttgataagcaaacacagcatcatagtaagtatgtgcacggtcggctaatcggatgctggctaattctggttctatcaaacccacgactggcgaacgcaatacagccgcaagcggaatatcttgatagggattgtcaattaattgcagcagcgagatcatcgtgcgaatttctgtcgcttgaaaataattttgagcatcattcatctccaaaggaatatccaatgttttgaaaatctctaagattgttaagttgttcttctttgtaggtgtcaagagaacaatgtctttgtactctatcggacgacttttctttgattttttatcataaatcataaaggaggaatcaattaattgacgaatttttagtcctgtcataaaaagttcgccttctgttttgtcttccagtatatcgtccgtcggaatctcgatctctgattcttcctgttctttttcatagatcatgatttctggctcaaactgttcattctccggaaagtctgaaaatccctgtatcagtttggctgcttcgtcataattgatttgacccactgctggatccattagttgttcaaaaataagattcgtaaaagaaaggacttcttttctagagcggaagttctcagccaaaacgatccgacgtccgccttctttctttgaaaaattctcgtatttcccgataaataaactaggatctgctaaacggaaagaataaatggattgtttgacatccccaaccataaacatatttccttttgtatcgtcaggttctcttagccagtataaaatggcttcttgtaattggttcacgtcttgatattcatctaccattacttctttgaatttttttcgataatgttttgaagcttcacttggcagccatgcatctttcgttttttctgtgagaatctgcaacgctagatgttccagatcattgaaatccaacacacctttttcccgtttacgcatactgaaaccgtccataaagctttgcgtgacttttgtcatttcttcgactaacggtagtgctttttccgttaattcttctatttggcttggtgaaacaggaaagtaacttttacttatctgctgaatcaatttttttgctttatccctcatgcccttgacttcattagagatttctttcaattctgctttacgactgctcttaaaagttgaaaaagtcagttgttccaaactagcataagcttcttctaaccgatcttgcgagaaagcttcatagatatttttgatctgcagttgttctccagccacttgctcatgcattttttctaatccttcaccttgtgctaactgagtcatctgttcatataattgtacacattggtatatatctgccaaaactaaaggacggatttgttcttgatataatcgagatttcgctagcccctcagtcaaacgataattatcgcttaactgttctagccatttttgggggtcagggttggcacgggcaaactcataaagagaaaacaccagattcgtcaagccgtcatctgaacgatcattagaaaagttcattgttaattgaaaaaatcgttcatcattttctgcataaagtgcttctctcagctcgtcccacacatcctccttcatcaagatcgtttctgtttcatctgttaacatgcgaaagaccggatcaatatcaattaagtaataataacgtcgaataactgttagacaaaaagcatgtaaggttgagatattcgctgtgggcaataaaactaactgcttagtaaaatgctgtcttcgtacagggtcgctttcgctgttgaccgcttcttgtaatgcctcttgaattctttctttcatttctcttgcagctgcttcagtaaatgtcacaatcagtaattcatcaatatcaaaacccatttttaatttttcaatcactcttcgaacaagcactgtagttttacctgatccggcagacgcagagactaacaaattatctccttgatcgaaaatcgcctgccactgatcatctgtaaatcgttcattttgcggttttaaaggaatttgattcactcttcttcactccttttcaatattctgcgcagtgcttcttccttatctattttctccagacggtggtaattattttctttcagcatcacatcaaacgtacagatgcttctgaatggacaaaattcgcaggcaattcgctgtttatctttataagctgggttcagtttgatttctccggaagtgattgcatctccagctaaccgcatattttcccgattatgcgccatgaatagttgcagttcttcttccgtgaaaaatttatctttgctgaaactacctttttggtattcatctttcgcattttttttcactggatagatcagtgattgttcttttgcttccagtgaatgatctagtacttctaaaagagcgggatcatcgacaaaaacgccatcataactaaattttttcaatgtattcttctctacatcatctgtctctgtcaatacaggattatgaacatgtaaataatatgaacctgctggtttaacagccgcctttccagtcaaacgtaccgcatccatcaatgctacgtctagatacgtcaataattgcatagccatgccataataagcttctgtgacatcgaatgaacgtccactagatttgtaatcaacgacgcttaaccaagtgtcttcttgttcagaagctacatcaatccgatcgatttttcctcgaacgtggagtttaccaccattactcaacggtaattccagacccgtgataccttttgctccagcaatctgaccaaataaaatctccgtctgaagaggatgcatgcccgtatttttgctctgtttgtgcaaagcccatgccactttttgaatcgtctgtcctaattgatagcggatatagttcattcttgcagaactatccaatatctcaaaccgaagttctccgaacacttcttgcagcactttttcagtaaagtctttacgctgcgcatcggtcatattcactaaggataattggtttgaaaacagtagcttgaagaaacgatccaatgattcatgataaaaatcacctgttgctgctggagtcagaccataaacagttcgttctttcaatttcaaaccaaattgcatgaagtatttgtattcacaattataaaaattctccatacgtgaaatcgaagtataaatttcttttccataaagctcttccgccattttttctggcatcgaaacaggcacattcaaatgttcctgactttcaaagatttgtaaagcaaaattgcgccatgaggaattcagtactaattctttgagcttttgccagtgttttggtacaggtttcttttcatctaaagctaatcgataaatcctattgactgtattgattccgcttctgtaagttcctacataacaatcaggatcgctttcgatcgtcaaatgctcttttctctcgacgggaactgataaatattctgtgattctgcgcaaataaggagacatcttcagtgaaccatctgtgtcatagctttgtgcatagctaagatataatcgatccgttccggaaataaaaacaaggtaggcttggaaaggctcaaaagagatactttcttttgatgggtcgaataaaaactgtccatctggcaaagcttgatttaatacttctcgttcttcactggacaacaatccttttgtttctttacggtctggaaacacttgatcattcaaacctaatgcaaaagtgacggcagcttgattcggtcgaactaattccaaacggttgattcgcacttggtcgattgcggtagggattttaccataacttagattttctagaccactcgtaatgatttcttggaacagtgaccagtcaaaagctgattcaccataaatgactacatattcatccagcagatcaatcagcgctccccatgtctgctcatggtttcttgccgcttctaagtttcctctgtctacttcctgattacgccaaaacaataattgttgctgtacaccactttgaatcaaaaattgataaaaaacatttgcggccgcttgtcctgttttgcttttctttatttttttaaaaaatgcaggtacagctttctgaaataatcgtctaatcgtatttgactgttcttccagatattgtacgtcttcaatctgttctgcttcaaaatcatacgctacaaactgccagtctttttcacgcgtccagtaagtgccttgataattataagcaagtgcaacattttctgtgatgtccaattttttcctgaattcatctcgttcttgtttccattcatccagttcggtttctgtttccatcgataggaacaattccgtcttaaaaaaacgcataatatcacttaatcgataagaatagcggtcaagagcgaacagactgttgatccattcaatcagcggatgattttccatcatttgttcttcatcgatataaaatggaatcgccatttcttgaaagattggtcgaagaatatttccatataaggacatattttttgtcagtacttggatatcacgataacggtagttttcttcactgactagccgtctgatttcaacagctaactgtcggacttcctcagttggattttcagcttcccacaaatggagagcctcttgttcccctaatttgtggacggttgctttcttttggctggaagtctcttcccacatcgtttgcagcaactgcagcgctgtcggacgattctgctctggcgcaaaacgatctactaatataggaactttccgttctctcgcactttgaaaaagacggaaataaagctttccagtctcatgaaagagcgtaagtacttctggaagatccgctgtataaggacgatccaacaataaatcgacaactaattgccccttttccatcatcgcctgcagtaattgatactcttgcccattgattcgggaaaaaccgctgacgataaatttgacgttggtgaaatcttgtgtctgcatataatttgctagtatagccagtgcatcttcatttgatagggcacgttcggtcaattcgctgtcataagctgaaaaaatcagcttcaagtctttcattttaagttgctggtcttctgcattcggtgaatcaccaaataaaagcatcaagtcttccggttgaatattccctatgcgcaattcactatagagttcttgcaattggcgaataaatcctcttttattgatttctccgcgaaagatcgttaattcttcctcatgtttttctaaaatctgtcgcaagatcatcgcagatccggattctgataactcatttcctgtaagaagggttgtctgttgcagcaaataccaagccagacggtaaaaactgaatacttgaacatttgttgtgctgaaagcttttttcccgcttcttcttcgcatctccgctaaaatttcttgttcctgttcgaatttgctgtaattggggacaaggaaaaatacttggttgcttgcatcctggtcgagccaagctgacgcttcgtcgatcaagacttgacggtgatcttttttcccatttccaagaataaattgtaaagacatgcttttcctccttcaacacatgatacggtgcttctttattatatcaaaaaatactgaacatttgttctatattcttcaaattatatacttttatggttctgatatttctatcttttttgagtatacgcaaaaagacaggaatcgctacaaataagcaattcctgtcttttcgtgagttgattaatggatagatcccattagttttttgattggttctttcacagtaaatagcaagataccaccaacgattgctactgcaccgataataccgaagtaggcagattccgttcccggtgtgtagaagcgtgcaatttgtgcattgattgcttgtgaagaagcatcagctaagaaccaaatagcgattgtttgtgattcaaatgctcgtggtgctaatttcgttgttacagacaaaccaactggtgaaagacacaattcagcaataaccacgatgaagaaacttcctaacaaccacaatggacttacttttccacttgtcccataaagcatacctggcaacatcaatagtaagtatgataatcctgcaaacaaaagaccaagagagaatttcactactgtagatggttggcgtttgccaagttttgtccacatcgttacgaatatcggtgtcaaaataaagatgaaaatcggattcaatgattgataccagcttgcttggatcgtcacaccaaatagtgtagattgcgtacgttcactagcaaataaagctaagatagatgaaccttgttcttgtaatgaccagaaaatgattgctgcaaggaataatgggatatacgcccatactcttggtttttcttcagcagttacatcttttgaagtcaacattttgataaagtaatacaacggtaagataatccccaatacactgattgtattgacaaaaaagtcgattgtcagatgaccagttaattgtgccccaccgaatactgcagcgataacaacaagtgcgatgatcaagttacggatgaatcctttacgttcttcagttgtcaaaggattcggcggtgtagtacccactccgtctaatgtcttgcgtccttggataatgtattgtaataatccaaagaacatcccaatagcagctaaagagaaccctaaatggtagttatattcttgaccgattgtcccaacgattagtggtgctaataatgcccctaagttgacacccatgtaaaaaatcgaaaatcctgcatctcttcgcaagtcagtctttgaataaagatgtccgaccataccagaaacgtttggtttcaaaaaggcggttccaataataatcaatgccattgaaacaaataatgtacttacaccaaatggtaaagccaagacgatgtgtccaagcataatgaagactccaccaaagaatacagtacgttttgctcctaacattcggtcagatacccatccgccgacgatactagacatataaatcaaagatccgtatatcgacatgatagctaatgctgttgctcgtggtaatccaagtcccccgttggcaactgtatcgtacatataatagataagtaatgcacgcataccataataactaaatcgttcccacatctcagtgaagaacaaagttgacaatcccttcggctgcccgaagaagcccttgtcttgctgtttttccataatctataccccaattctttaaattttcagaaaatattatacatctttaccgaaaaatttaactaaaaaacttatttaagaaatataaactaattttctataaaaacaagtaatttttaatggcaatatcataaaaaaaagaagatagagatttaataattatatatcagctgtttttttcaaataagcaaaaattcctaaaacacagcaatgaaagcgataaccaagaaaatccttttctgacgatttcccttattaaaattgttttttgaacttcgcttattttttgtgagcatatctgtttacttactttttgtaagatgctatacttcatttcgtaatcaattaaaaaaatgcaaaacgcaaatcaaaggagaaattttattatgacaacttttactgacactttaaaaaaccgccgttcaatctatcatctaggacgtaatgtttcactttctaatgaagaattgacagctttgatcaaagaagcaattaaagaaagcccaactgctttcaatgctcaatcaacacgcgcagttattcttttcgaagatgcacatgaaaaactttgggaaatcactgaagaagcacttcgcccattgactccagcagaagctttcccaaatacacaaaacaaattagctagtttcaaaaatggttatggtacagtattattcttcaaagatactgacgtggtaaaaggactacaagaacaatttgaattatatgcagacaacttcccagattggtcagaacaatcaaacggaatcgcaacagcgaacacttgggtagcattagttgataaaggattgggcgcaaacctgcaacattacaacccagttattgacgaagcagttgcaaaagaatggaatattccttcaaactggaaactacgttcacaattagtattcggttcaccagaaacaccagctggggaaaaagaatacatgaacgatgcagatcgcttccgtgtattcggataattttacttgaaaaaaacagaggttgtgacaaacattttgtcgcaacctctattttttattctggatcgatcataatatcaatctccgcctcatcgttcaagcgttgggacaaaaatggaactaattcttctaatgatgcagaaaatttcagcatcggtccccgccatccgtttcggaaaaaattcatttttacaattttagaaccttttggttggtacaacacgattttattgatttcagaaaaaggaacaccttttttatcaaagctattcaagacaagcccttcttctgtaattcctcgactgtccaacaaaaaactaataaaaatcatcgctgacaaaatcccttttgccaattcatctgctgtaggctgactgatgagtgtgtaccaaatgactagtactactaagaatggtatgaccaagtagacccatcgattccgaacagtccgataaataatttcttttcgcaccagccaaagaaataagaacataacaacaacgaataaaaacaataggaccgtaaaaaatgttaccatgacaactcgcctcgctttttcttctcctgaaaacaggaaaagaatactgatttaccttctcaaagaaattggacttgcagcacgccgcacgtccaattattttctttattcaaatgtatcatattttgcaacaaccatgcttgctttttcatctaataactcttgatcctctgcagcacattgggcaactttgaccacggcacagtttgtcatttttgatacaacttcaccaacgaccgtttttgtaaagccaattggtttgcatgcatattgttctcctaaattaatcatttcttccgtcatcaaaatcctcctaaactgctggaacttttctccatattacaactgctattttttggagatttaactatttgattttttgtttacagtcaaaaatcaaccttacaggcattatagcgtactgttttcgttttcacaattaaaacagctgttgtatctagaagaattttttctaaaatcgcgaattgtaaaattaagttagaaaaataaaaaggcatttatggtacactcaaattgttcttttttattttttagttacatagacattcagaaaaaaagacaatcaactagtgatcgtcttttagaaagttaccaatcaattttataatattgctagaaaataagataagagcaagacctaaaatatttataaaaaattgaaatctaaaaaaatagcattaaggataacaagaatcatttcgatgtataataattaatcattcttataaagatatcgcaaaacaatgatgaaaagaataagtgataaaaacaacccaactacgtaaaaaaataatgctgaaagcgattgataaaatgtatatttcactatttttatgataaaaattgctgtaggaagaaaagaaagcattaatataactgtttttctagaacgtttagtgaagtaaaaaaaagagctgataccaatacggactggaatccaaaataaaagcatgctaaatgtgaccaccgtatcatctcccatatcgtcttatgtcaattaggataatagcactttatcaactaataaccaaatattaaggataatagttccgaatggactacaaacacaccagaatggaaaaagtcagaaaaccggaactaactgaaataaaagcaaagtttaaaaaatacggtgttcctacagaagcagtggataaaattgcgagcaattgtattgccggccatcattcaggttgaaaaagtaagtagttaacgaagaacaaaaagaaagtagatagatatgagatttttaatcggagatcatactcgttcattaaacaattgttgtgatttttctgaaattttacatcttttaaaccttatatcgagtgattatccttgtgttagtattatatccgtgttacagtaaataagtaatctaatttgaaacgtaatctgagcgatatattcacactataaaaactccttttaccaagtaatattaattgcaataaaacacgtattatatacgtatcaggaggaaatatatatgaataaaggtacagtaaaatggtttaactcagataaaggttttggtttcatcactggtgaagatggaaatgacgtattcgctcatttttcagcaatccaaggagaaggctttaagtctttagatgaaggccaagcagttacttatgatattgaagaaggtcaacgcggtcttcaagcagtaaatatcgtaaaataatgttgaatgttaaccgcctcatatgaggtggtttttttgtttatgttggtagaaaaaatccttcactgtaatattaggtgagggatttttttcgttcattgattaagtttaacactattgtttgatttagtttgtttattttctgttactcagtttttacttgctttgatatttttttctgaaaccgtcaaatcataaagaagatacttttctgagcaaaggaatttacatattttaccaaatatggtttaatggtttaaacatataaaccaaagaggtgagctacaatgattagacatgatcgtttaaaaacagaactagaatcattgagtggttttttagcagcgttaggtgacacaaaaagacaattgatcttgattagactattaaatgaaaaaagctgtcatggtttgcaagtaggagaactaactgacgatacaggtttatcaagaccagcagtatcacaccacttgaaaattttaaaagacgccgatttattagaggtcagagaagaaggaactaaaaatttttactatctaaaacacgaaaataaaaatatatacaaattaagagattttttgaatgatgtaataactgaaatagaggagctaaaagacagtgaagaaaattctgatcgttgaaacaaacgtcaatcaatataaaggaacaaataaagctactgggctttggctaggagaaacagtagaatttttagcagaaatctataaatatcagtttgaagctgattttgttagtccgttaggtggctatgtgccgattgatcctagaagtatgaaaaatctagattctgatgttatggacatttattctaatgcaacatttattgaaaaaggtttgaggaatacgttgtctcctgcaaacgtaaagagtgaagattatattgctatttactttaccggaggacatggtgtgatgtgggattttccagaaaataacgcattacaaaaaatagcgagtgatatttatgaatcaaatggctatgtattatctgtgtgccacggtatagcaggtttattgaatatcagacttgctaataatgactatttaatagcaaataaaaaattgactggttttactaaaacggaggaacgattagcgatgaaaagcaaagtagttccttttgataatgaagagatgactgtaaagagaaaaggacattttgtcaagaagcgtttctttaagagtcatgtggtaaaggatggacatctgattactggacaaaacccgtattcaacaagagaactagcacgaacattcatcaaggaggttatctaaatgcaaacagttattggtagtaatggccaaattggatacgaattagcaaaagaactcaatcaaacgtacgggaaacagttgcgcttagttagtcgaaatccgaaatcaatcaacgatacagacgaactaatctcagcggatattttagatcgtgaggcaactattcgtgctgtagcaggaagtgagattgtttattttgctgcaggattaccgatggactccgaacagtggaaaacaaaatttgaaatcatgttagaaaatgtcatacaggcttgtaaagaaacaaaggcgaaattagtttttttcgataacacttatatgtacgaaaaaaatgacacggaacaatttgaggatagcaaatttatttatgatggtatcaaatccactgttcgagctaaaatggcagatcggctagtgactgaaatggagaatcctgacatcgatgtgatgatttgtcgcgctcctgaattttatggacctaataagacgcaaagtattacaaacagtttattgtttaaccgagtgaaagacgataagactgctttggtaccaatttctgatcaaactttaaggaccttgatttggacacctgatgctagtaaagccatggcacttttagcaaatcatcctgacacttataaccaaacttggcatctaccttgtgatgtaagtcgaacatatgaagagatgataaagttgatggaagaaaagatgtgcaaaccggtaaaatataaagtgatcaaacaatggatgtttgatcttggttctatattcaataaaaatatgcaagagctaaaagagttactacctagatatcattatgataacaagtttaattctgataaatttaaaaagaaatttccagatttagaaataacaacattctccaatgcgttagacgaattattcaaattagaaaagtaatgctactcgagagaaaaagcgatagttgccatccactaaatatggaaagtcaactatcgctttttcgttttatctcatgactagaataacagttgccaagtaaagccaaacttgtcagtcacccagcaaacttccgtatacttttcgtaatttttttcatgcatcattacggttccgctatcttttaatgtattaaatgcctgatcaaattcttcctgattatctacttcaatcaaaatggtagatgcccaggtggagacaggcgcagggaaatcttttgacatatccaaaaatccaattacttgattgcctaacttaagttcaccttcaaggataagatccgattcctctttgctcgcatccccataccgattcaacttagtgatttgggagttaggaaaagctttgtgataccaattgattgcttcttctgcttgaccattatatgtcaaaaacggtaatagttgcttcatctttttccctcctgcttccttttttgagatcgattgcaaagcgattgtaacatggaatgggtaaaaaagactaaagacaggaactgaatcgaaatggtcattcatcagtctagtatttatataaaaaggcagacagcaaatataatagggcaatatgtgccggataaaaaatataaaagaaatattttattccttttcctttttgtccgttatatagcaagattgggatgattgaaaagatcattatccactgggtcgtacctaaaaagaagaatattccagcaacaatcgaaatgatgacacattgaatgttacgatgatttcttgctaaataaagcaaaggaatcaaaagaaccataaaactattttctgccaaaagcagtgcaggtaaaaatgatgtaatcagcataaaaacaactttgttttgaaggataacaggactagaaaataacaacgggataaataatgagagcaagattggtaaaatgaataagagaatacttgtaacaatctttttccaactacctgtattttttccctcagtgaaaagatcgattgcatacatcatgaccgtaccaataaacagatctctgaaaatgttattcattaatactacttcatcataatgaacgatattacctaaaaaataagtaaaaaaggccataagaaccattgagagataaagccgctgcatatatttctttttatcatgtgtatgtgagaagcctacaacgcttataaaaaagaacaaagtagcaactggtctaccaaaccaatccagccagtcggggacaccaaacggataaaacatttgatgaatgtgatcgacaaacatcaatgtaatccctaaaattttcaagtcaaaggtagaaagtcctcttttcaaacgaacagtattcaaattttcccctcctaatgattaaataaaggaaacaagtgacaatcacattattaatgaattgaagtaagaaatacaatcgaaaagtcgaacatttttgtcatgtgaatcactgcaaaaatcaaaacaaagtagaaattatctttggaatatcagagaatgagggggggaaaatagtatgtaactataattaaatgatgtaaacttataatttgcaaataatttctatgccaatgtatcacgaacctaaaagtaatccaatttgtctaaacgtttatctataataaaaatgtgcaaaataccgcacttttttatctttttatttggttttaatgcaaaaaatcaagttacaagattagttgggacaaacgtgtttatacattattttttattcaaaaaaatagcacaatggcaaagaacataagtgagagcataagccccaaggaatgactaaaaagaaaagcagaatcacatgccatgtcatcctaaatttcttccagaaaataaataagcggaaaaaagggaagaaacagcaaaacatcgatccagcaccattttcccccccttttgaagtaacataaaacaataaacatgaatgtgcagggaagtaaaaataaagctttactcatagctaacaaaataccagctccttttattctttatccctcacattcaaagagtaacaatggtatgtacttaataatagaaaaatggatcaacttgtatgaatatcaaatgaaaagttctacgccaaaataaaaaacttccagccaattttgactggaagcttatttttttctgaaatatcctaacacacaaatgaaaaagatggccgaagctaataaaccgatttcgtagtaaaacaatgaaataccagagtcataataataaaagcctctgattttatggataaaataaatcatcggacaagcagataaaagtaagtatttgttcggttttttgaataagtaaaagaaaatactggtcattatgatgaatggtatccaaaataaaagtttacttaagacaatcaaatgatcaactcccatattttttaccaagagagatcataccatctttatcgccaaaacaaaatatttttttgctcattttgaaaatttaaacatactcgttcttatccaaatatataaaaatcgcccctcatccatcgagaggcgataagttctaatttaactcaatttttttcgtttcttttggatgatgcgccgttttaggtaatgctaatttcagtacaccatttttaaaggttccggtgattttttcttcatcaacatcaggaagatagaatgaacgtttgtaagagaccgaatgtctttctttccgtacatagttgccattttctttatcttccgtatgggactcgtggttggcggagatcgtcaaagtattgtctgaatattcaactgtcgtgtcttctttgtcacagccaggcatatcagctgttagtttgtattctttttcgttttcaactaaatctacttttggataacttgaaacacctaaaaaatcattgaacgctggactaaacacatcattgaaatcagggaacatgtcgcgaatgctaggtacatttgccatttttgatcatcctttcaatagagtattttttatttatccctatttatgtaataactctattttgaaaaaaattcaagtataacggttgtctttgtgaatgtttcatctagtgaattacaaaggttatctttctaatttgagaaagggtttgctagaataatagtaagaaaataatttagagaggagaaaatatggcaaaaaccacaaatccctattggcgagaagaaagcagaatctatcatttagaattagaaatcgctaggacaagcaatccacaaaagaaacgtgaactcggctatcttttagaaaaagaaaaaacagctttgcagcaacgaaaatggcgagatcgagaagcgcgaaattaccaaataaaaacgatacgtaaaacccgtagaagaaaaatcgtctattacacatgttgtatagcaggaatcatcatcgtgtcattttttataataagcaaattcttttacccaaatgtagaaaaattggatttagaaaaccatccggcgactaattttattacacaactgacaaaaagcgaagtagataccacaaatttaacaagagagcaagtagagaagtgggcatactatcatttgaagttagaagatccaactattgtaagcgctaaccattattggtttgacgttcgtatcaatcaagttagagaagtagaagtagatatttttatggaagaagtagctgtagcaaactatgtagttgacgcaaatggtcacttatatcgtatgactgcatctgacaaaaaaatggtggcgaataaatgggacgtaccagagaattttgaaatagaaaacgcgaacgattgagatactcgttcgcgtttttcaaaataaaatagcgttaaaacacacaatgaacagacagaaatgtgaaattttctatatcatcaaaacggtgtgccgtacgcatcagtaatcaagatcactccatcgggggaaactcgatagaaaccgacacttcctgatcctccttgggcacgagtctgcttgctagaagtcgtgaacaaataatcttgatcgattttttgataaaagctagtaacgatatcttcactttgtaattcggaacgatgggcaataagaaatagaagtgcttcatcagagttttccaatggaagagaaggttcagttctttcttgcatttcagatgttgaagaaatggtagacgactgaatgcttgattggctatattgagaatctacattattagtagaagtattagtaatggaagcagtagaagtacttttagttgaaccgaccacaggtgttgaattggttagtgaagattcattgatagaattctttgtagcatttccacaggctgaaaaaagtagtacaacccccaaaaatcctacgtaaatccctttattcatgatggtacctcctaaaatagattatcttgattcagtataccactttccatgtggaatcagatgacttcaaataaaaaaaccttcccactaatgggaaggttcatgaagataattgcttttttaataattatagctttctaatatctttcatcaacttttctagtaatcatagggaaaaatttcaagcagtaaatcgcacaaatacctacgatgatataaatgatcttcgcaaaaatagttgttgaaccaccagcaatcatagctactaaatcaaattcgaacaagcctaccaacaaccagttcagccctcccacaatcaataaagttaatgcaatagcatctaaagttttcattagaattctcctttcttaaatgataaaataattatatatcaaaaagagaaacattgcttatataacgctcagggattttagcaaatgatgcaaaaagaggaaaaacaagtaaaggtatcgcagataatgccttcaatcaaaaaaagaaatagacttacaaaacgtctgattttcaacattgacagtcagaaatacttgatgagctccgatgagggatgaggaatgacttgcggactcacttatccataaaataaacgatagccttctcgaaaactcgagaaggctatctgacgattcaatattcattaatttaaagtttcggtgactattactaactattacttatttctcatttaaacgatgtattccctaacctctaatacatccttgtaactctgaagttacgccagttttgaataaatttcataaaaacaaatgaaaagtgtcgcataaaaatatctttcgtgtttctttagtataacagaacaagaagaaaaagtccataaggatatttttagctcgttttaaaataactttttaaacaggtttaagtttgctatacttgtttttgaggtgatttggcaagtgaaaaaaaagattggaatagtaatgctattcactgttttattaacaggatgtgtttcattagcaaataattggttggaacatgaaggtacttacttagtggctcatcgtggcgcacacattattgcgcctgagaatacggtggagagtatccatcaagcaaaaatattaggctaccaagcagtcgagattgatgttcggacaagtagagacggcgtgaattttttgatgcatgatgacacattggatcgaacaacagatggaacggggaaaccagagacatacacgatcaaacaactaaagaagtttaatttagatacgaaaaactatccagaatacgtaaataaaaaagttaagatacctacttttgaagaagccgtaaaggaaatcaaaaaaaataacttgattgtcaacgtggatggttcaaaaggaaactggcaggatgaacattttgttaatgacatcgtaaacacgctaaaacaaaatagtgtgtatgaacgttcattttttgtactgacggataaaaagatccgagacgaagtcgtaaagaatcatcctgactgcacagtatcttggttatatgaccaaaaaaataaacttgaagatgagattgaacaagtaaaaagttataaaaaagcgttgctctcagtatctaatgatgctgctacagaagaaacaatcaataaactaaataaatctggaatcgagtatcaagtgtatggggtaaatgacgttaaacgatttgaagtgttaaaaaaatcatccgttccaatcgtagaaacggatgaaatcaatcctagtgatttataaacataatatattcattttatgtaattattcatctttatatccatttttgaacctaggtcgtcaagttgacttaggtttttttatatagcatgttcataaataaaaaaacttcttttttattttatattgatatgattgtgataaattcagttacttgttttggtatggaacttgttttggtatggaaaaaaataacccgcatgaggtcgtggcagaagtgttcatctttaagaaataagaagtaatttccgaaacttgcttgccacatccccaatcgggtcaaacttgtttatttgaatatattttttacataaggatctttaatagttacattgtcttttttcatcactttatggattgttttatccatgaattccgtatcaagggtttttgtttccgtggcgattttttctagctctgatttgtatttatctttattggcacctttatcctgtttttttaccatttttactagataatagctttgctgataagtcgttggatctgttacaggaatgatatcagaaacttccccgttgtttaattgaaatgctgctttttttacttcagtaggaatccctggattggttgaatcaaatttcatttttccatcagtttcctttagtgttttattttttccataagcttgaacaagcttggagaaattttccccttcatttacttctttttttgcattatctgcttcttctttagtcgaaaatgggatgatctgtgtactaacttctggatggaattctttccaagcagtgtctagatctttatctgttaattttacattggctttcaaaccgtactggaaagccagcatctgtttcaaaagtttcttatatgtctcttccgtttggccaactgcttttaattgttccttgtagtttggaccaagttttttgatttgttcattatattcttttgttacttcctttgaagaaatctcttttccgtatacatcatcaaacgctttgaagacgatcatttttcttaatagtgtttgattgtttgatttaacttttgggttatcataaaaatcctgaactgtaagtgttccacctttaaacgttgcaattgtttcattggacttgctacaacctgagaatagtaaaatagcaaatcctgaaaggcacataatcagtagttgttttttcaaaaaatttcccatcctttccttattaaagacagtctaacagaagaaccaggcagacagtctttcattttcgtaaggttgctgtagacattcttagttcgtaaaaattttttctctctatgatggagaacatttagatatttttcacgagacaagaaagaaaagggttattacacttaatataaaggagggatgaaagatgatcaggattattcgattgattggatctgttttaatagtcttagttggttttgttttaggaattcttgtcaataatgcacttgcggatatgtttcttggagacagtgaatggattggagcaattgctggtacggttggacatttagttgtttttttactagctttatttcttgctagtaaggtagaagggaaaaaagtggaagattatggtatttctggacgaggaaaagactggggatatttagcgggaggactcgttggtggaattggagtgtttctgcttattactagtccattatatttgataggggcgtatcggttagattcaggaaacgcaaatattgtgccgctgatcacgagttttattttatttattgcagtggggtatccgaagagcttttattccgtggcttttttcagcaccagctgcttagttttggtccattaatagcaatgattggatctgctgcattatttgctcttttgcacggattgaatcctaacatgacatttctggcagttttcaatatctttttagcaggttgctttttcagtgcacttatctacagtacagaaagtttatttacggccatcggtgctcacattacttggaattggactcaaggagctattttgggtataccagtcagcggaacgcaagaacaaggttttttctccactctggttcaatcgcaaaacacaatagttactggggaaactttagggctgaagcgtctatatcgactacattattcttgttagtcttgattgttggtttgttactctatgcatataaaacaaagcggatgaagaaatacactgctgtttatcaataaaagatgaagaaagcaaggctgatatcggtcttgcttttttaagtctttcattgattaaacgaaaaagtaaacagattcaaacgaatacacgacatcttttgttagattttcacaactgactgtcgtgttctcatcattttcattttatataattcctttatcaaatagaaggtaattatatggagagtgattgaaatgaagaaaacagcgaccgtattatttgttattcttgggctaagtataattgcagcaatgattggaatcagtacttctgcaaatgaacggacaaatgaaaatctttcatttactgtgaaaactgatcggatcgtttatgacgtgacacaacaagtcattactattctgatcaaaacaaataaaagcgtgaatgctagtgatatacatgctgttctaacatatggttgggatggtaatggaagttcagaaaaggttattggggaagtttatttaaaggacgtacaatggaccgctggtattgagtatacaataatgatttctgcagaactatcgattgatgagatcaagagtaaagataaagttgatttgattgttttttatgatggacagatgacgattacggagaatttgaaaccaagtagttggacagttgttggaccgtcgagcagtacagatagtacgagtagtgaaagcagtacagaaagtacgagtagtgaaagcagtacagagagtacgagcagtgaaagcaatacggagagtacaagcagtgaaagcagtacggatagtacgagcagtgaaagcagtacagagagtacgagcagtgaaagcagtacggatagtacgagtagtgaaagtagcacaggaaacacaagtagcgaaagcagcacgggaaaagtaaataatgaacttgatttggtacctatcataccaactaaggaacaaaagagaaatgcagggagcaacctaaaaagtgtgctaaaacagtctgattttgtttctcgtggaattgatcatcaagaaaaagcgaaagaaacagataagagaaaaagcgatttaccagaaactggtagtagaaccataaacaagctaattacatggatgggtgtgttactcattttgattgtaggagcaagctattttcgttctctcttccatcgagtgaaataaagaataaaagcaacagatttaaaattgaataaaacgatagatttttgagtgaatatttcattcgagagtgctgtattgcctggcgaagttgtagctttgccaggtttatttttgtttactaacatatttgagaaacaggaaataacaggaacgcaaagattattttctttaaaatcaacaagatgaccagaaagcaagagttcgttgagctcttgttttcttttagttttaggaaggaacatcctgattttatcttcgctaaatccagtcaaaagttttgcaggttggtcgtagataatcggttttttcaataaagaaggggacgtacgaatctcaatatatagttcactcaaactgagctcatctattctgtgaacaagatttttataactaatagaatgagtagagagcatttcggtcacgccattgtttgtcaattttagtaagtggataaattcatttttggttagtggttgacgaattaagttctgttcgataaacggtatatcatgtgtgataagccaacgttttgcgcgtctagaagacgagcaactagaacctatatataatttaatcatgatacattcctccaatagctaaatatttatgaaataataacatgaagaaatagtcgaaaagtgccatttataggtgtaaaataagaaattgttgtcacgtataaaggaactaactagataagaaatactattaaatcaagaaagaaggcatacgtatgtcaaacacagccgacgcattcgtagtgatcgatttacaaaaaggggtatgttttgattcttcgacgatacacggattaaaaacagtgacagcattagtgaataaaagaatcaaagcatacgaaacgattggaaagccagttattttcgttcaacacgaagatgatcaattagtaccaaaaacaaaaccatgggagctattgtcggaattatctattcctgaacacagttattttgtgagaaaaacccatgcgaattcattttataagactaatttgagtatgttattaactgaattggactgtcattcgatcgaattatgtggggcgcaaacagagtattgtatagatacgactgtgaagtttgctcatggattaggataccagcttatgatgtgcagaggagcagcgacgacttatgatcatccttttatgaaagcaaaggaaacaatcgctttttacgagaatatttgggataaacgatttctgacatttttggagcaataagctgtttcattgtttaaagaaaagcagaatggataaaccagtatccattctgctttgttacgtaaattgagaaaataatcctgttctatttttatgggataaaccgtttgttttttgtataaaaaatgtttgcgtttacatataattctcctagaatcataaaaaggagtgaatcgattgagaacaaaacaagtgttaaagggagcgttggtcgtcttatttgctgtaagtacaaacgtcccgcaatggtcagtatatggagagagtatcttttccgaatcgggatctagggaggtcgaaaccacggaaacaactgatgctagaaacgaaacgaaatcgagtacttcacaaacagaaacaagtactgaaacaacggctgagacatctgttactagcacagatcaagaaacgaccgctaccacagataaccaacaaacagatgaagcaacagctacagaaacgccaaacgacaaatcctcttctgctaaagtaagtgacaaagagaatgggacagaaaatgatgatatcggtaaaggcgaaaacttcaatggtaagaaatatcttaattacttcggtaaacagatgacagatatacttaatggaccagtagatgaaattaacgcacgactaataggtttagtattaagtgagctttttggtaaggattatggtgtagacaaagagattatcaaacatctgattgctacttatctattgtatgatatcgctttttctaaaaatagtgtgttgatgtcaatgcttggaggtacagatgatggtacgacgcctacagaaaacacaggcttctatccaaacacaaaacaacttcatcaaactgtactaaacaaacaagacggcaaaatgatggatgtgtatgcttactatgtcgaccagggttcagataaaacagtcatgatccatggcggatttagagggaattggaataatgggatcgttacagaagaatacaatgatttttataaggcagggtataatttattatttgttgattccagagcaactggtaacagtggaggcgattatgtaacctatggacaatatgaatcagatgatgtcctttactggatcaatcaagaagttcgagaacgtccatctcaaaagatcctgctgtatggtggttccatgggagcagctacgatgatgtctgtattagcaaaagatatcccagtcaatgtcaaaggaattattgaaaattgcggatttgcatcaatcgatgaacaactacgttttacgtatagccagacagtagtccctgcattaccgcctgccataaaaaatcagttagacatcattggggatcaagagcatgaagatttgtttatggggcttttgaaacaatattattttgatcaggagatgcatttggatccgacagccgctctacctacgattggaatgtctggttcattgcctaaattgatcatccatggaacggcagatgatgtagtacctgtgtctaacgcgcaaaaactatatgagttagcaggagggtataaagaccttttattggtagaaggagcagggcatggaaaggcacaggaagttgaccatgctgcctacacgaaacatgtaacggactttttgaaagtagtgttccatgatcagataaacgtgaaatatgtggatgaaaacaataaaagtctactcaaagaccaggacgaaatctggctttacggagcttatggagagaattatgtgacagagcaaaagacattcgaaggatacgaattagcaaatgttgaaggaccgactgaaggggtttttaacgagacggcaccaactattatttaccattacaaaaaaatcccagtagttccaccaaaaaaacaagatccggcagagaatgcagacaataagggaaaggatgaacctcgagatgatcaatcaagtgatgatacgctaccgattcagatgacagtgaaagtacaaaaaaagacagatacaaaaaaaggaatgttgccgaaaactggagaaaagaaacattcgcttctcatttattcaggtggatttttatctgctagcacgattatcacatggatttggcgaagaaagagagggtaaatgaatgaaatggttcaagcgaatagtgattgcagtgccagttatcatcgtagttattttagtcactgtatttttgattaatcaaatcacaccaaagccgattagtttgcttgttagaaaacaatttgacacaagtgaaaaagaacaagtatatgccagaccagacgatttccagcaaaaaatcaaacaaatcgatagaaataaagaaataacttatccttcaaagtacaaaaacaatcatatggatatctacacaccgaaaacggagaagaaaaagttgcccatccttttctggatgcatggaggcgcatatgtaggaggggataaaaacgattgtcgtgattatttggaatacctatgttcagacacgcagcagatcgtcgtaaatatcgattatgaacgatcacctgaagcaaagcatcctacaccagttatccaattgaacgaagccattcaagcagccaaaaaagagataaaagagcaagcggattggtcgaatatttcgattggtggcgattcagcaggcgcacaaattagcggagagtatttgttagcacttcaaaacgaagaaatcaaaaaagccgatcaacttgatccaactttggagaacaagcagatcacaaaatttgtttctttgtctggactactagacccttctgcatttacccaagtaagtgataagatttctagctttctttatgcaaaatgtggatgggcttattttgatagtaagaactttgaacgtttagaagacgtcaaacatttagctttagcaagacatgcagaccgttggacgcaaaaaacattcttgacggatgggaacacaaatacgtttacgaaacaaatggaacaaacagcttctgcatttgaaaaagtaggagtgaaagtcacaaaagtagactatacgaagaaaaatgttgtcttgaaccatgaatatcagtttgattttagtaataaacaagcgcaagaaacataccaaaaattagtagcatttttcaaggaataaacgctcatgatgtaaaagaggatgtgaagaaactgcttagttccgagtcagaaggaactaagcagcttctcaggtttgatgaatagtgggactggtgactgaagagcttgtaggtaccgtgtatcagttctcgcgaaagagacgtccagcctattgtcaaaagattgtttatggaaaatatttattcggaataaggaaaggtgatatgtttttttttacggtctcttttacgtaaattttatagtcagatttgttgtttcgatcgtttaaaaaaggcaacaaatccgaatccagcggaggcaaaaagggataaaagaccgagcggtaagcaaaagaatgctggttctactaatattccgttgttattgatataaggctgggagcaaagatgaatagcaaataaaatcaatgcactagcgaaaaaaagcaaagaaatatgaatagctttcatacgcagcacctcctttttttataattataggatagatagattaagaattcataaatgtgtcaagtttgttagaacgtgaacaaaaaataccatccatctatcataagtaagtttggagcaaagttatctcatgataaatgaaaaaggattcatccatcatatagatagaaagtcattagtatatgtctagaccaataatgggaaatatgagaaaataatagaaaaggtttaggacaccccccaaaaagaatttccccaaaaattcgatgtatcctaaacttttttattttacataacaatcataacaactgtgaaataaaattacaaacgataacctaatatgtattcgaaagccagttttatccggagaatgcttaattcatcaaatatttatttttattttttagaaaataagaaacaaaactaataaaaaaaagaaaaaataaattttttccctactgtatactatccttgttatcgcatctaataagtcactcgaataataccaatacaaccttctccaaagatgtgataacatacgttctaacccaccgactattgatgttctgtaccacccttacagaacccgaaaagccactaccaaatatttggtaatggctttttaggttttaatggattttttactttttctgttatagtaggattcttcctttttttaaaaaagatttagttgattgagttagtcgaatacaatcgtcaattagatggagggttgtcagatgagaagaagttattgaaaacacaaaacgcacctactgttatcatccagtagatgcgtttaaagagaagaacgagaatcgtccatatgagggtttccactccttatgcagatttttttaattcttgcactgcttgttcgatcgtaacacctgttgctacatgattgctattttctttgtcaaaaacgacaaagagattcaaatctgtatccaaggttactcgatattgtatatctttgttatagaatgtcatagccattctcctttctttaaatacttgctgaaaggcaacgaacacgttgataacgaaattccatttataagtatatcaccaattgaaaggttttcatagttaagaaagtttaaagtcaaaatttagcaatcatgttgtaaaataaagtggggagggaacacaatgacaactatatttataaatgcaagtccaaacaaagaaggtatgactagtaagtggggagcgaaagttctagaaggaatagattatgagaggatcgatcttgtagattttcatattgctcaattaggtcaagtcaaagctaatgatgattttgatgccgtcatggatagattggcgaaggcgaactacgtagttattggtacaccgatttattggtgggatattagtggactgcttaaaacgtttattgaccgttggacagaattattccaaatcggacttgattcagaaaacgcgccattgcaccagttaccagtactatggatcgtccaaggagcagcgccagaagaagccataccaggcatagagagaatgctagaaaatattagtaaacgattcatgatggattcacaaggaatactatatcaaaagaaacaaatctctgaagcaaacagacaacttaaacaaatgctagtagataaaaacaaataaatggagaacaataggcggctcaaacgcggttatccaacttttttatcgattcgaagacaataagttttatattttattgcattattcttgtgttattagaaaaagcatgatatattaaataagtaatctattttgaaacgtaatttgagcgatatatctacatagataaaactccttttgcctatcaaatatttattgcaacgaaaaaacgtacattgatacgtatcaggaggaatttatttatgaataacggtacagtaaaatggttcaacgcagacaaaggttttggcttcatcactggtgaagatggaaatgatgtatttgcacatttctcagctatccaaggcgacggtttcaaaactttagaagaaggccaagcagtgtcttacgatgttgaagatggtcaacgtggccctcaagcaataaacattgttaaagcttaataaaaattgacttttaaccgtcttttctttcgaaaagacggttttttttgtacgaagaaattcattgatcgttgaataggcggaaggatgtttttcttggtgcttttttgcttcgtcctttgctttttcatttcatagctgtgtttgtttgtcaataggtattttcgagaagtattttacataaagtggtgtatcgattattaaaacaataaaaaaacagataaactattacttttgcataattatttaaagaaaattaaaacgaaaaagcctaatagtagtaagattttaaaaggattttttttgtttttagataacgatatttatttgattaattttaattatgtcttttattttaaatgtattgagcttatttttttatttaaaaataactatgttatgtattatgaaagttataagagtttttaaataaaatttaagaacatttagaaattattaagctttaactgaaaataaaaaaacgaaatgttattattttagtctgttttcagggggggataatcttatgataaaaaaactatttttactatcaacattaacactagcaatggcaggttgttctacaaccgattcggcaactgaatcaacaacagaaacaactgaagacacgacagaagaggtaaaagttgagacgatcacagaagccgaagtcgacgaagcacgggaacgctgggcagaagcaatcataagtatcggtaaagcaagcgaagaaggtatggaggaagcaacagaaaaagcagaagaagtcatcgagacattgtatgcatacgacgaaggtgctgtgctttttaaaccaactaaagctgcagagttaccattcagggcaacaaaagaagaagcactttcttatttcgttggcggtgatatcagcgaagattctggttttgcgttagaaccttggacagacatccgcttcgacaatcatgaaacgatcatcgatacggattcagcaatcgcatcaggagaatattactttacttctgggaaaacgggtgatgaaacaaaagtagaatatactttcggatttatacgtgatgacgaaggtaacctgagaatcaacttgcaccattcgagcttaccctacgttggttaagactttttcgatgagtaaagagtagaagagtttttcatgttatattagagcgtgggacaaaagtaaagaaaaacttttgtctcacgctctaaacatgtgtaaacggcggaagcagaagcaactccttcggaaataagctgaaattcacaaagatttgaaaagcaattttcgtgaattacctcttatttcttggagttaaacgcttctatcccagcctcttttttaggtaagataaattcctttttgctccaaatttgctaaacactctgctagatacacttcatcatgttccggataaatcggaacgctacgttctacagtaggcaaatcaaaaaatgcttcgcatgatttgccacggtacataggatctgtccattctggtgctgggctgtagccacgcttttccatttcgtccatgacaagttgatgatattgaaataatttataaggagaatagtggaagacataatctacagtagcgtgtttctttccccaaccatttcctcttaacgcacagcattctcgatgttgtcctaaaagctgctgacgaggaagctttgaaatcaatttttcatgccataaacgcatagatacatctcctttttgtacatagtttgttcactttaaacattaaatgaaaaaaccagcacaatggctggaaaaaatcatttcagtttgcttgctgtttctgagcgaccaatcaggtagtcaacggaaatatcgtaaaagtcggcgatgtagatcaattcaatgatacttggaatttcttccccttgttcgtatttacgatatttgaataaaggaatacttaacgcgctagaaacagctacttgggataaagatcggccagttcttaaaaaattcagacgacaacgtaaagtatccagtaaaatagcttcttcgatactcatttaatcacctttcatcataataggatagttgtaatgaccatagaaagctacacaagcaatcaataggactcaatgttttttatttaaacgtatcaaataaagaatgacgattaatagagacaaaaccaaccctgataattcttctacaaaaacactatcaggttcaaagtagttgtaattaaaaaccttccacataaaataaataaccggaagagtcaaaacagctaaataaagccgttctttgttccaatgcataagataaaaaataattgcgatcaggacgaccgaaggcaaccaaaacaaaactctaaccaacgtaatcatgtaacggactcctcaacatttcttctaataaaagataacatgttattgcatacatcacaaatgaaatgctaggaaaatcaaagaagaatagaccgatgaaaaagcggaacagctctctgctcatacgcgagaactgttccgctaaatacaagttatctatctagaaaaaatcaatggattgatatttaagtaattcaatacatataaaaagaggacgattgcattcattaaaaaggaaagaatgatgatcccgtaacgaatagaaacatatttaacaaatatttctgtctggacacgtgcatatttttttcctttgtagctgattatcatgatgagaaggagaagggtgatcacaccttggaaaatcattccaacaaacacgacttctgaactttgatgattgtattggagaaagtaagctgctgccgcaaccaaatcgaataaaatcgcaataaatggcaaaataatcactcctagcattgagaatttttaaaagaatagcatttcttctaaaataagcaagtaaaaaatagtcaagtttcaagtcaagtaaataagaataaatatatcaacccgtggtgctagttaattttttcctagaggaaaatgtctaaacatgttggtaaatcaacaaaaaaacgcatatagtagtctcaaaactcccaagaaatgaggactactagagagtagatttgacagcatattactggcttacagtgttctattaagtcgagcacaacgacgttttgaaggaactttgagatattctttaggatattaaaattaactagcaccacgggtaaatatatcatattatttatattttgaagcttgtgagcgtctataattcgtgctatagttaaaaagtaactaaaatatatctcatgatgatgtacctttagctcagttggttagagcagacggctcataaccgtccggtcgtaggttcgagtcctacaaggtacataagaggttgtgaaaaagctgccctgcatcaactaataagaacagccaagtaaaaacagcttcttatgtttttaacttggttggacttattaccgcagatgcaagcttttgaacaccgtttaaggaagaggttgtgaaatcagcgttttgacctgagtattagagaaacaaacggaaaaatagttcctcatattttgccgtttgttaagctaataccgagagtcagctgattgaacaccatttaagaaagaggtcgtgagcctaccgtttaactctgagtcacaaggagcaatttcaaaaaacagcttcccatgtttgttgaatattgtgacttgtgactgaggagttggcaggagaacactgtttaccaaggtgtcatggaaaagccaatatacttttgtagaaaaagcacgtaagactgaaaacagttcttcgtgctttttcttttttatttgcttgctaaatgataatagaacttatataaagaatagactgtagcatacgtgtgactgtctatttttaggttcaatgatcgaaacattgaaatccttcagaagttccaacgcagattctccatgttttctactagaaactaacgttggatcaacaaaaaagtcagcttcaggaaacgcactctgcaagcctatcaaattagagagcacacataagtttgtttcgatcccaaccacttcgatctctttttgttcttctttgctttcaaacaaagtctccttgatttcagctaaagtttcaggggggatcgtaaagtaatactttttgatcactcgttcatttccttggggagaaagaagagggatcaattgcaaatcttcccgttcctcttctttgtccttcagttcgactggaatatcccgtgtgaatagaatatattccttgtttttgcgtgctttagctaatcgtttagcaatgcgttccgccaattggtctgattctggaatataaaattcgctatttggatcaagaatatgattttgcatatcgataataactaacattttctttcctcctacgttcatgacgtcatttttttattttcaatagaagttttttaaaatataagcaaccccagcttcctcattcgtcagtgttacttggtttgcaatttcttttacttgccgctgtgcattccccatcgcaatactcaacccactataattcaacatagcaatgtcgttttcttgatcgccaaaagccatgatatcactcgactcgattccaaggtaatccgccagaaaaacaagtgaatgagctttagtgatacctgtaggcgtgatttctaagaaatgcggatcagagaatactgaattgatgccgtctgcttgcagatctctttgtaacttctgtagtttttcttcactcttatctgttaacgctaatttaagatagctaagagaaggatcttctaacatacttaaaatttgatcaaaagaatgattctgcagattgaaatgttcataataggggtcgtctttgacaagatttgactcatcgaatgtcagctgatcatcttgggtttctcggctggcaataattgagatttttgcttcttgagcatagaagaaggcttttttcagagtatcgatatctattttcgaacgtctgagaacctttgccatctttccatccttcatttcagcaatcagcgaaccattggaagaaatcaaatagccgccgatccctaattcggaaaaaatatctttagcagaaatgctgttccttcctgtagctactgttacgattccgccattttcatcaaatttccgaagtgcctggatattttcttctggtatctttccatttcgatcaagcaaggtaccgtctaaatcaatcgctgctagtttcattttatcttcctactttctttttacatatctattttcctgttaccttaagattaaatgagaaattaaaaaaatgaaactaacttgctttgccgttatgaattttttcaaaaaacattcttaagaaaaaggtggctatataatagtagtttttggtcaatacttttgaataaaaagccatgaaaaacgaatagttagcgcttactgatgcgttttgtaataaaaaaattttaaaatattcaatgaaaacaaagcatatattttgctttaaagccaaatgaggaatattctagatgtagaacaggttagaaaaagattagaaaaaggagtgattttgatggagaagagatacggcgtagttcctgtggtgactgcttcagacgaaaattatgctccttacttgagcgtgatgatcgcaactgcattagaaaattgcaataaagcaagacgcataaaattttatgtgattgacgatggtctatcagaatatagtaaacaaggattggaagaaacggtaaataaatattcaagtaatgcaagtatccaattcctgacagtggaaaaagatatctacgaagacttcctagtcagcgaccatatcacaactaccgcttacttaagaatttctttacccaacttattagctaaagaggattataagaaagtcctttacttagattcagatgtgttagtgctagacgatatcgtaaaactatatgatgaaccattaaatggaaaaacgatcggcgccattatcgatccaggacaagtgaaagcattggaaagattaggaatagattccgatgacttgtacttcaattcaggggtgatggtgattgacatcgatcaatggaataaaaaagaaattacagaaaaaactatccattatttaagtgaaaatggtgatcgaatcatttatcacgatcaagatgctttgaatgctgtcctttatgaagattgggaacaacttcatccaaaatggaacatgcagacttctttgatttttgaacgacacccagcaccaaatgaaaaatatgaacgtctgtataaagaaggaaatgaaaaaccttcaatcgttcattttacaggacatgataaaccttggaatacgttgaaagatcatccgtataccaatttatacttaaaaaaattagcacacagtactctaacgaaagtaggcgagatcaatgaataaaaaagaaatagcagtagtcgcaagttgtaacacaaaattcgtaccgcatttagctgcgttatttgtctcagtattagataattgcaacccgtctaaatttgttcggttctatgtgattgacgacgatatcgattttgaaagcaaacagcttttacgtttctcagtgaaaaatgcacgaatgaattcagatgtagaatttttgaaaatcaataaagaattctttacaaatgtagtaatcagcgatcgtattccagaaacagcttattaccgcatagcgattccggaattgttccgcggcacggaagttgaacgtatcttatatatggattgcgacatgattgctttacaagatatctctaaattatggcgtcttgacttcggtgattcaatcgtagcagctgttgaagacgctgggttccatcaacgattagaaaaaatggagattccagctaaatcaatgcgttacttcaactcaggattgatgctgatcaatgtaaaaaaatggttagatgaaaatattacgcaaaaagtattagacttcatcgaacataatccagaaaaattaaggttccatgaccaagatgcattaaatgcaatcttacatgatcgttggcttccgcttcatccgcgttggaatgcacaaggctatatcatggctaaagcaaagaaacatccaacagcagcaggtgaacgtgaatacgaagaaacacgcaacaatccttacattatccatttctcaggacatgtgaaaccttggagcaaagattttgaaggaccaacgaagaaatattacgaaaaatatgcagggatgacggcgttccgttgtgtggctaaattccctaaatatccaaaatatgcaaaaattcaacaaaaaacagacgtagttgttaaataatacaagactacaactgaacagggggagtaggaatggaaattacactgtctaaaaatgcagtagagacgttaatcgaaaaagtgggggaaaatacaaaaattgcactcgctctcatcaatgattccgatccatttttaagggataaaggtgcttttgcaaaaggcagctttttccaaatcattccttttgtttcggaatttggagagtatgcaacaaaaatcgagcatcctttactggagatctatacatctaaagtagaacaaagttatttcggtaaacgactaaacatggattttaataaacagcttgacagcttctcattagaaaatgaaagtgcagtactcgattataatatcaaattaaagaactgcttcttcagctaatcgtttttgaaaagtccagaaaggaggtatacattgagatactactttgtggatgatgaaaagaaagtcacagaaacagatgaaaacaaatacaattggcttattttcgataataaaaagccagaagagatccagcaggcaatcaaagaatttgagcttccagatgatattttcgtaggcacggaatatccggaagaagtttctcggatggagcgcctttatgagaccaaattagcgcatccattttctttggttgtgatcaatctggatcagtcagataatcgtatcgaaaaaaaattgacaccgatatcttttgtactttccgataatctcttgattacatgtattgatagaaagaccgagttcgtggatcgcttgctgacaaagcatggagatcatttaaactcgtttgaaaagatcatcacgtatacattactggatatttatacccattacgtgaaagaactaagagaaatgaagcatagaattgacgctttggataaagcagctcgtaaaacgacggagaatgaggaactgtataaacaggcagatcttgaaagagacattgtgtatatcgatcataccttaagagatcagcggaaaacgatgaatcaattatggaattctgaaacgtttatcaaacgtttagacgatgaacaattgctttatgatgtccatttgaggcagcgccaaacagaaaaaatgatcgagatctatcgagacttattggagagtattggtgatttattcaatgggatgatggacaataatctaaaccacatcatgaaatatctagattcagctgcactaatcatctccgttccggcgttgtttgcagggatttggggaatgaatacaggagggttgccgggtaaaagctctgctttaggatttatcctcgtagtattcggctctttgatagcagcggcggttttaggctaccatctataccgaaaagattatacgaattaaacaaactatttaaaacaggtatcaaacaaagaaatttgttttggcaatacaatttagaaaaactaggaggaatacagcaatgacagaaccaaaattaatcgatccgcgaaatctgtaccatacggagaaatttcctaagcaagatcaggatacgccagctttacaacagaacatgattcctgttcctgattgcggagaagaatcctatgagggcagtaatcagctggaaaaccgacgtgtactcatcactggtggcgattcagggatcggtcgtgcagcagcgattgcatttgctagagaaggtgcagacatcgctcttcaattcttcccaggagaagaaaaagatgcagaagaagtagctaaatacgtcaaagatgcaggacgtaaaatcgtcttactaccatttgatcttcgtgatgaacaagcacctaaagaaatcattgaaaaagcagtaagtgagcttggtgggctagatacgatggtattgaatgcaggacagcaaatttcttgccagtccattgttgaactgccacttgaacaaatcaaagacacattcatggtcaacatcatcgctatgtttgctttagtgaaagaagcagttccgcatatcccagcaggaggagcgattgttacaacaacatctgtccaagccttcaatccaagtgaacatttattggattatgcagcaacaaaagcttcaatcgctaactttacgattggcttagcaaaacaacttgctcctaagggaatccgtgtaaatggcgtagcccctggtccaatctggacaccgctacaactagacgaaggtcagccttctgattcaattcctgaatttggtcagcaaagtttactagaacgtgcaggtcagccaggagaattagcaccggtctatgtcttcttagcatcgaataaagcaagttatgtcacagctcaaatctacggagtaactggtggagaagcgatcaacttataaaaagttgatcgtttcacccctatgaggaggtgcgaaaatgaataaaggagtaaaaacgcttggagtgatcggaacgttacttttgctatctatacttttgtttgcgatactattaagtgcagcctatccactgccttttcaattagagaagtttcgattcttttccattactaattcatatgtgcaacaatatgtattctggcttgctgttgcatttgctattttgacgattatcacgttgcttgttttcttgttttatccaaaaacgatcggaacctttttactgaaacatggtgatggggagttgacgttggataaaaaagcaatcgaaggaatggttcgttctcacttgcatgaagatgaatttatccattcaccaaaagtaaatgtcaaagcaacgaaaaacaagatcgccgtcaatgtaaaaggggagttgaaacgaacttcagcactcattggtaaaacgggaacattgatgaaagaaatcgaaaacgaagtacaacacatattaggcacaaaagagtcagtgaaagtatccgtgaaatacacaggctttgaagaaccagctaaacaaagtaatgaccgcaaacgagtagaataggggggaccaaaatgaaagaactattttcgacatacaagctccctatcatctttggggtacttgggttgatattagccgttttatggataaccgtcggctttttcaagactttattgatcttgatcatggccgctatcggtgtcgctatcggtttttatttgaaacaaacgaaaatcttagatcactattttaaatcttaggaggaaacatccatgaataacaataacaaaaataataataacaataaaatgaacaaccaaaaaccagtgtctgcacatccagacccaacgacaccaaaccaatcaaatggtgtgaacgatgaaaagaacaaaacagcaccagtatctgcacatccagatccagtcgtgccaaatgttcaacaaggtgtagaagaaaagaaacatgacgcagaaaaacatgcgcctcatcatcccggctctccagaatctaaagttccagaacaacatgatgcaatcgatccttctaaaccattagaggaacaaaagcacccttctgatcatgcgaaagcacaagaaaaacttggttctgaacactcaaatggacaagaaaaatttggttcacaacatacaaatgaccaagaaaaccatggctctgagcaggaagattcgatgcgcggtgagttgaattatgaagacaaagtggtgcaaaaaatcattggaatcgcaattgaacaagtagacggtttattatctgcaaacggtggtttcttctctaatatggcaggaaaacttgtgaatacagataatgtaacggctgggatcgaaacagaagtcggtaaaaaacaagtagcagttgacatggatatcattgtggaatatggcaaagatatcgaaaaaatctttgaagaaatgcaagaagtaatcggcaaagaagtaaaaaatatgacacacttagacgtcatcgaagttaacgctaacgtagtggacatcaaaacaaaagaagaatttgaaaaagatcaagaaacagtgcaagacaaagtaactgacgcagggaaaaaaaccggtgaatttgcttctaatcaaacagataaagtaaaatcagcagctggaagcggcgttgaaaaagtaaaagaaaatacagagccacgcgttcagtaataaggaagcaaaacattaggaggaacgaaacatgggatttatttggtcacttatcgtcggaggaattatcggagcaattgcaggagcaatcacgaataaaggttcttcgatggggattattgcaaatgtcgtagcaggtttagttggatcagcacttggccaagcattattaggttcttggggaccaagtattgcaggaatggcaatcgtaccatcattgattggtgccatcattttagtactgattgtctcattttttgctagaaaactgtaaaaagacttttaataaaaaggtcgtgaaaaagctgttctgcatcaagtaataagaacaaccaaacaaaaatagcttttcatatttttcgtttggttgggcttattatcgaagatgcaagctttttattcgaaataaggggctgtgacaagattttgtcatagccccttgtttgtgtgggtaaattcccaattagatttttaaaagttttttaaagaaaaaccagtatgttgaccagtttttccttaactgtgtctttattgatacagataagctttctccacctttttttaataaaacaatgtctccctaaattttcttgagagagggaaggtgaacatacaaaatagtacgaccacttgaaagtcccagatgatccacaaatgaatcgtatgatactgatgaagtaaaaagcaatggatcagaaactcaaagagattgaaaaagacaaggaagaaataatatctcttttttactcttgtctgttttagccaataatagctcgtaaagtaatctagacaaacaaatagaagtaaacaaagtttcgtaagagcagtaatcgcatcatgttgctcagctagacgattgacgagcagaaagaatgttggtaatggaatatagatcacgagtaatgaaagaaaaaagtaaacgatgaatggcatactattcctcctaattgtgtgaattcgtcctcattttaaaataacgatatttgtttgtgaagctttttcgtgtcgtaacaaatgttatctaatgtatttttaaataaataatcattattatcaaattaacgttaaaaagaaaaatgagtagtggatcgttgttattcgaaacattctgtcaaaaactccatattaaatggtaaaaagtggcattacataatagaaagaccccctttacagtataaatgtgggagtttgctcccgcataaaaacaaaaagaaaggagtgggagacacccagttacgattattggggagagaactacatattcaaagatcgtaagaaggggaacagaagcaattcacgtacaatgctgaccgtcaagtttgtcacaacaaatgatcgttaggtgtttagcaaaataaatactatttgatcgatcagacttgtgtcaattgagcaaaagctacggaggttagaaacaaacaaaactatttttacactatttatttatgtttaaaacaagaaaatagcataccttctttgctgacggtttaaaacagaccgctattgatctgtataggaaaaataaaggaggtaaaacattcattgaaaaaagtaaaaaagttattgactagtacactatcgttgggactggctctagggaatatgggcggtaccgtagtagaagccgcttctgccttacattcgattgaattaccagtattaaggcaattacgccctcaggaagagaaagaacaggaagaaacaaagaaagaggaaaataaaccacgagcatctaccttgccacgattaccaatagaagaaaaaaaagaaacaaaccaagttgattatatgttcccagagacacgattgactagatggacaatggaagaagtggtaacagaattaatggatttttatgaacgatattttgtatacagattcaatgaagcgatggcaaatcatgaccattcctttacgcgtggggaatttttagaactaacatatgacacagatatggatgttcatgatgtaccagaaattgattctccaagtttttcttccaatgtactttcttcacttgggataactagcacaagtatagcaatcggatctacttcagatgatttttctgcttttgtagatacaaagagcgggaattggagatttagggcgctgatggttaattggggcgacccctataagataagattaactaggataggcgacgaacgaaacttaggtaatgaaagtatagagctacgtgttcaagtgtatctttccggacctaatgcgtctcatagacaacacagattaataaatttccactctgcagcaaaatcaatgggagagcttggagtcgaagccaaatctggcacacataatttatgggaaggcgatgcggtaccagatccttctgattatgtgacgattgatcggagtaatgtcaaatgggatctgaagacagaatgggaaactccacctagaatggatacaattggtactcaaaatactagaatcaaagtaactgaagatacttctggcagaacgactactgtaactgtgccgatcacggttcaggatagagcactacaaatcactggaaaggctggtccgcattccatttacgtgagcgaagcaatccctaatcctgctgactactttgaagtgagagaccctcttggacagacccatcagttagagtggctcgatgctgatacgagctcagttggtacgaaaacgtggcgggcaaaagcaacggctgctgatggacgtgaagctactggttcgatcacgatggatattcttcctcaaccagagttagaactaaaattgaaggatgtagaagatcgacatctcggtggaaattatcctgcactttcctcttcattccgtgaatatatccaagaagcgacgatggaagggcaaaggcttaatacagctgacttagagtttgtcgccgatgaatcaacagagccagattcttctatcgtaggagaacaggcgctcaaactgactgttcaaacgagacaccctgttacaggtcgaatgatcaaaggaacagctgaaacaacagtcaatattcgttggggcgacacgttcttattgaaagcccatgatggacgatcagctggagcatacgctttccagttgaggaatgggaataatgctcgaatcgtggcaactcgaggattagattctcctctcgatgaacggattggtcttgaagattcgttgtattactctattgaggtgctacgaaatgaccgacaagcttattaccatgaggtgccgggaagagctactctacagcaagtgatcacgacattcggaaatggaaatggataccttgatgtacagttgggcgatatcatcaatattcaccatccacaaaagagtgcaggaagctcagtcttgatggtagaagaagaagaacaggacttcacttacggaacagataacgcctattatcgtgtcacagctttcggatttgaaccacttcctgtactccctgatccggcgatccaactgaaattgaagccaatggaagaacgtacattaggagaaacttctgcgtcactggcaagtacgtttaaaaattatatcgaagaagccacttttgaaggggaatcagttgcgatcgaggatttagaattcgtcgcagcagaatcgacagagccgacgaatacgattgctggcaaacaagatattcggatcacggtacaagcgaaacacccgatttctggggagacgatcaaaggaacagccgaaacatcggtcaattatctttggggagatacattcatgatcaagtcaagcgaaggtggctcagcaggagcttattccttacatctaagaagtgggaatgcagctagattaaccgttaccagtgggttgccttcagcattagatgaacgggtcggtacggaagaatcgatgcacgccttgtattattctttggaagtcctgagaaacaatcagtcaatctacaattatgaggtacttggtagaggaactctgcggcaagtgatcaataactttgggaacgggaatggctactatgatgtacgattggatgatgtaatcaagatctatcacccacagagatcaccgaacagctcagttgtcatgatcgatgaagaagaacgggatttcacttatgattccgaatatgcttattacagagtgactgcattcggactagaaccgattccagtgatggaagcagaagggacttcgcaaacattctctttgagggaggacgtcagcacattagatgtcaaagaactagtcaaagatgtcacgatcaatcatcaaagtatctcagaagatcgttacacgatcgaacaagtgtcagagattgacacaagtacaactggaaaacgaacgacaaaagtaaagattacgatgaatgatgggttagctgaaaccgaaatcgaagtgccttatgaagtacagtggggaagtacattcgttcttcgaggactggaagaaatgaccgtcggcgcgtttagtttattaaaagaaggcgatcagttagcaatccatgcttctcctggttcaagcaacacggacttgaatcgtccagtgaacaatccgttcggcagaggaatctattatgccatcgaagtgcttgaaaatgacacgcgaaaatacaactatgaagtaacagggaataccttgatccgtcaagcagtaaacggcttcaacaacgggcagccgttagcagtcaatgtaggagataccatcaaagtctatcacgcggagacacaaggaagaaatcttctgatgatggatgaaatggtcagagattacacaggtggttctaattatgcctattacagagtaacggaagaaggattcgagccatttacagatatcaaggctgatccgatttcacaagaactgctgttaggacatgagacgaatacagtgaatccggcagaattgatccaaaatgtgacattcaacggacgtccgctaacgagtgatctttatacggtggaacaattgtctaacttcgatacgacaacagtgggagaaaaaggggttcgtgtgagagtaagcacgactgatggtactgggttcacagaagtgaagatcccttatgtagtgaaatggggaagtacgatccgagtcaaaaacaatgacggcgtaacgattggcgcattcagtctaattaaacagacaaatccgaacaatcagaatactcaaatgatgatccgagcatctcaaggtgtggcaaatacagagttgtccaaagtagtgcatgattattccgatcgctcgatttattatcaattcgatgtgatgaacaaagataataccactagcagattcacatatgatgtaacaggaaaccgaacgatcgaacaagcattgtctcgattcaatagtggacagccattgaatgtcaacgtaggagacattgtcaggatctatcatacgaaagagtttagacgaaatatgttgatggaagatgagcaggagaagaacttcacttacggttctcaatatgcttattatgaagtcacagaatatgggttcgaaccaagcgggaaaattgatgtagaagctaataaagtagaaatcccacgaggtgcaacggatctcgatcttaaatcatttatcaaaaatgtaaaagtaaatgacaaggtcattccagaaaatctttatacagtctctttaaattctgaaatcgacacatcgactcctggtcggaacaatgtcgcagtcaacgtgacgactgacagttcttatggcggtttttcaacagaattgaatatgccgtatgaagtacgtgatcacacgacggaatccagtacgaatgaatcacaaaataataacacgaataatgatggaacaagcggcagtacggaacgaaatgaaggaacgacaccaagcatccaagatgatccaacaacaagtgcagataatgaatcttcactgaatatgccacaaaccaatgcaactaggaatactgcatggatgttgattggtatcgcgttagtagcaggcatagggacgattgttatgagaagaaaagcaaaagagaaagttgaaaatcaataaccgttttttgcttaagtaagaaaaaatagttctcaaagttcctattcctaaaacagataaacgatataatataattaaaggcactcaataagggaaaccgacattgagtgcttttacatttatctatcaggatgtatcaaaaggattttgttagaaagggatggaaacatgttgaatcttctctcaaaaaaattacaacgtcagttgaatctgttagaaatactattcgaggaggaacgttgccgtcttagtcaattggaaaaaagattggcaagttctggaaaaacattgcggaacgattttatagaaatcaatacatattcttccgatatccaaatcgtcactgatcgggatgctggtgtgacagctatattttcacctgctttcacaaaagatcatatttatcagatcgtgatctcccaatctactgaatataaatatttagaaaccatactgctacatccaaaagagaattatttagaattagcagagtatctgtttatttcagaaagtacattgcgaagaatcgtaaagaaaacccaatcaaaattaaaaaaatacgatttgaggatcaaagggttgactcggattgtcggagagggtcaggtgatcgacggtcttacagctcgtttgctgatggaaaaatatccttctcctgctagtatttttaatcgttcttttagcgaagcaatttatgacgtggttatcctatttttaaaagaaaatcagctgtatgaggtagcaaaaaatgatccgaaaaccttatgttttttacatttttttattgcttgtcgtatacaacgattcaacaaaaataaaatggaaatggagcaaaagaaaatcagctgtttcaccttttcattcttggagaaaaatcacttgagccatttttctttgccatgggaagaaaaaatctggcagtggatatttgatacagaagtcatccatactgctttgaaaataagaaatgcaagcgagcaaagaaagtatcatttttgtatcagtaattgtttaatgacatggatggattgcttggaaaaaaaatatcagttggaatgtgagaacaaagatctgatcgttcaacgatgtaaagagatactgacacaaccacgatttccagaatatatcctaaatgatccaagccagacaacgatagtcgatccgccgattttagcctgtttatatgaagaactgaagggcaggatggttgatgactgcagagaaaaaggatacgtcatccctgaactcgattcatttgttcgccatgctatcttagaaattcttttcgactggccgttattgctatcatacattgaagggaaagaaaataaattaaaagcagtgatagtcataaatacaagaaaaaaacaggcggattacatagcaaaaagattgcaaaaaaaattgggagactattatcaatttagtgtcatgccaaactttaatcagaaagaaaagaaatcatatcatctagatatcgactgtattattacaaatgtaatgattgatgatgagacaaacattccggtcttcggtatttctctatttccaaatcaacgtgagatccaaaatcttctccatttttatcaggagaagtaccaagtagtagaagaaaagtctctctacgtgtaaatacgtatctatagacaacaggatattccatcaaaataaaatatctgagtaatagatgtaatgaccgctaaagttctcgtacatctattattcagattatttttttactgattgttatgttttatattcctttttttggtataggatcggggtctttttggtaacttaataaatcccccggttgacactctaatacttcacagattttttcgagggtagaaaaacggatagcttttgcttttccggtttttagaatagagatatttgccatcgtaatacccactttttcactcaattctgttacactcatctttttttgagccaatactacatctagattaacgataatagccatgtcgcacctcacactgtcaaatcatgatctgtcttaagtaaaatcgcgtgttcgagcagattttccaacacgcttgtcaaagtatatacggcaaaaggaatgaatacgacagcaattcctaccaacatcaaaccaggagcatcatctaaatcagccactttcaaaaatttaggaagcaagccgaaaaaggcgaagccaataatcaaaatcgttcgttcgatttttttgagaatgtccaagctttgattggaaaaggcctggttttcttcgatttgtttcaacagtctcaataagaaataagcaataataatccctaagagaagggcgaagtagatgacagaaacgaataaagtcgtctgccaatcaaaagtgaatcctttttcgcttgtagcaatctgagtataaaaaagtataccgaataaaataaatacggcacttatacctaaaacaacaaactttaataataatgtttttaatttcatttttatccctcttttatctttgatagctaaaatatagcaggataattattgaaaagcaattaatttttatcgaaaaacaataaatttttgccttttttagcaaatgtggttttatagtatttgagagttttaattgaagttagcctttgattctttttgatttataaggaaacttttaaatatgttatttacaaatagttagtaaactatgttacaatttttatggggaaaaacttaaaaaataaatttttttattcataattgctgtttattttgttatgtaaaacatgcataaagtgaggttctaaaattgaatattttacagttaagctattctctactcatatcagggcagctgatgacgatgtttgttggattgggctatttgaacaagaaactaagaaataaaaagtatgctttattataaatcttagttatcctattaatatcggtgctttatcaatggataaatgtaattgccactggtttggtatggctagtcatgtgtgctctcgtgatttatcatgaagagacgcttcaatcagctttattctatgcttcgttatctattatcctacttattttttctaattatctgatttacgttatcttaaaatcattatctataatgatgcatgatttgggtatatgttttttatcaattattttatatttatgtttcgcattttatttaaggaatcatatattaaaaaaagtaccccttgaatcgatggtatatgatattagtaagtatactgttattgctacgtttttgatttatttcatttttcttatgattgaacgcttttcagatttagactgtttcatgaagggtgctcatgggatctttatgctggcgtatagcctttttgctattcttatcagctttttagctgtttatacaaaaaaggcagaatataaaagtaaagaagaaaagaatcgaatggaatatcttatcgaatatagtgagcaaatcgaaaaaagttatatggaaatacgcaagttcaagcacgactacaaaaacatactagtttctatggaaaattatatccaaagtaatgatatagatgggttgaaacattttttttactcccacatcaaggaaactggaatcctttttgatcaggaattgttagaaatgtcaccgataagaaatcttgaagccaaggaaataaaaagcatcgttttgagcaagttgtatctagctcatgaaaaaggaatagaaatagacgtaaatgtgccacaaaaattggattctttccccgttccttctatcatgctagttcggatgctggggatcatactagataatgcagttgaagaatcttctattatagataagccgaaaatcttgtttgccggattgagacaagaagaagcgataacctttattattgccaataaatgtcgttctgatatacctgatttacatgtattaaagaaaaaatcttattcatcaaaagggaaagaacgtggggttggtctaagcaatcttgatgaattagttcagttgaataaaaatgtgtacttagatactaaaatcgaagaaggacagtttattcaaatactgaccatttgggaggggtagaatctttatgttgaaaatttttgtttgcgaagatgacggaacatttagattaaaattagcaaagatgattcaaaattatttaatgatgcaagattatgacatcaaatttcaaatggatacctcggaccctgaagtgttgctttcatatatacgttcaaataaaacagaaggcatctattttttagatattgacttaagttccaatatgaacggaatcaatctagccgctacgattagagaatacgatccactagcaaaaattatttttgtgaccagttacacggatttagcttatctcacttttttgtataaagtagaagcaatggattatattgtgaaggggaacgatacactgctgcaagaaagcgtgacaaaatgtatcgatgtggctaaccaaagatatcttgatacaattttacctacaagagaacagattcgtattaagagtggaccaatcaatacaaaattgttcgtagacgaaatcttgttttttgaatccagtcctgttcctcacaaagtgatcgttcatcttgaaaatcgaatgctagaatataatggaaaaatcaaagagatcgaatcgtttagcccgagcttttaccgttgccatcaatcgtttgttgtaaatgtggataatatttgttccatcaacaagaaggaaagaacgatccttatgtctaacggagaaaagtgtcttgtttccacccgaagtttaaaaaaattattgattgcatttagcaaaggagcgtgacgaatgtcacgttctttttttatagaataatttagatataaagaatataagggctttattaagaaagaaaacactgcagttatgtaaaaaaacgcgcactttttactttttaatatatgcatccttatttttagtataatcaaaagtgagaaaggggtgaacgatatgccaaatgaatatctgtctcttgaagagaacctgtcaagcaagatgagcagaaaactcggagagaaatatgggttaacagaactggaggaagcaaaagtcaactatggattagcgatcctgttcattaatcttttcaagttcatgcttatttacgtatcagcgtttttcttacatagcattcttgctgtgatcaccactcatttgtcttttattgctgtacgaagatatgcaaaaggatatcatgcaagccgaagcatggcctgcacgctctatagtatgggattattggtggcgctacctgttttggctaatcattacaatttggaacttacacgctacgaatatttcatcggagcagctattcttagtatggttttaggaatcattggttcctttatcgcacaagaccaacaaaaaagaagaagcgtaagaaacaaactagttataacaggaataagcctcacgctgatcggttcagtgattccagcaaatgattcaagagtcatgatattactgggtatgttgaccgcaatcttacttgtattcattccaaaaaaagaaaggaagatcatcaaatgaaacacacacaaactaaatttagtctctcacatgcaatcacaacaattgctatcagcgttgccgaaaaggctgtaataagcggaagtacctgtattggtttagtttatgaaccaaaagtaccagaagcattaaaaaaagaagtagaaaaataagtaaaaataaaatggattaccgaataaaaagtaccgtaagtcctaaaaactgtgccaacagatcgttgacacagttttatttttttcgatagttttgtaacaaaaatacaaagatgaaaaagaataaagattcccatagagtagtagtccaactgaattctttactgataccaaataccatatttccaagattcgatacaatcaaatagccaatcgttatgatcaatgaataatacaatcttttcatcataggacatacctcgtttttctttataagaatagtataaaccaaagaagagaataagaaaaatgataatagaaaaataaagtaaaaacgcaataaagtaacttaagttattttattgcgtttttttcttcactgaaaaattttaacaaataaatagaattttgtaataataactgagcataatctttgcaatttttaatcttgaataatatcctttaagtatagccagcaatcaaaaagaaatagagaataagtgagtagttgttatttcagtatcagaatgacaataaaatgccgttataatccaatatcgtttggtaacgctttatttattggtgctaaactaactgttcgctctctatactgtgattgtcggtagagttatttacagggtaaaaataagtttataggaggtggaaaatgaataaggggttaaaaataaccggtgttatcatgagtttgctactactttcagtgtttctagcaattgcgttaattaatgcgccgtatattatgcctgaacaattggaacgatttcgcttctttaccttaacgaattactacatgcaacaatatattttctgggcagctgtagtatttgccgttcttgctattatcatcttgctagtcgttcttttctatccaaaatcaaaaggaactttcgttatgaaacgggaagatggcaaattgacgatcgacaaaaaagcgatcgaagggctggtacgttcccatttacacgaagaagagttcattcattcacctaaagtacggatacgttcaacgaaaaatcgaatccatatccatgtcaacggagacttgaagcgaacttcttcattagtagggaaaacaggtgtactgatgcaagacatcgaagaagaagtgactagagtacttggaacaaaagaaacagtcaaagtggcagtcacatacagcggttatgaagaacaagaagatacaagagactacaagcactctcgagtggaataggagggccaaataatgaaagaactattttcagcatacaagctccctattatctttgggggtcttggactactgctagctgttttatggttaacaattggatttttcaaaacattgttgatcatcattatgacagcaattggcgcaggaatcggattttatttgaaacagacaggaatagtggatcaattttttaaatcataggaggaaacaaagatggaaaacaaaaacatgaacacaacaaatggatcagttttggcaaatgaaaaaggggaaaaccgcatgatgaatggtgaattgacttatgaagacaaagttatccaaaaaatcatcggctatgcattgaaagatgtagacggtctattgacattagatggcggattcttctcaaatatggctgaaaaattagtcaacacagataatgtaacagcaggtatcaatacagaagtaggaaagaaacaagtagctgtggatttagatgtgattgtagaatacggtaaagacatcgaagacatctacaaccaaattaaagaattgatcagtactgaagtaaacaatatgacacatttagatgttatcgaagtaaatgtgaatgttgcagacatcaaaacacaagaagaataccaaaaagatcaagaaacagtacaagacaaagtaacagaagcagcaaaatcaacaggacaatttgcttcacgccaaacagataaggcaaaagctgctgtaggcaaaggtgcacaaaaagtcaaagaaaataacgaaccacgtgtacaataagaagtaaaaagtcagttaggaggaatttaaaatgggatttatttgggcattaatcgtcggaggtatcatcggagcaattgcaggagcaatcacgaataaaggatcatcaatgggaatcatcgcaaacatcattgctggtttagtaggttcagccattggacaagctttattaggaacttggggaccaacaattgcaggaatggctatcattccatcattgattggtgcaatcattttagtattagtcgtttcattctttgcacgtaaattataagcaaattgaagaaaaacttatgttgaaatgaagaacacatttgagaaccgcagcgaaacttgctgcggttcttttttatatgaagtattctttattccttatatgatttgtcaaattaagctagaataaaatgcttcttgtacatagctcaaaaatatatcttacatggattgtttcaaatggttttctattcaaaaagggaattttaacactttcaatgatttcatcatagttctctgtgtttatttgatggcagacttaaatctccccgtaagatatgtgtgttgataagtatattctaagcttacgatactttaaatcattccatttatccacctcgataatttttatagtcctcattgtaactatcaaacattaattacccatgaattttgtttaagtttacaaataagttggtttgttatctgtatcggtgtatatcaaaaatctaacagggggaaatttgactttttcctattttagtaagatagtatcaaaccttctcgagtgttttcttagaatcttccagcatacctagtgtaaaattttatggttacggacctcatgtgtcatgtctctttttctgtactcttcgttatatgattttttatttgcaaagactcaaataaaagaaaaaacccatgaccaaaattcgtcatgagcttttttgatactcgatgtaagatagtttttcaccttgtctgattggtatacttaacggatcaagtctgtttcaggatcattcagcagacgctcgacttgtactcttgtcgttaacggaacatctccttggatcgaatgagctaatcgagcatttcctaaggcaaaataaacggtcttctgtaaggaccacttctcagagaaaccgagtaagattccagcagcaaatgcatctcctgccccgattcgatcaagtacatccaagggataaactgttgttttctctgcttcttgttgtgtgatcaagtaaccacttaactgttttcttccatccacactttctcgcctcgtcccagcaaaccactggatatcgtagtgattcataaaggactggatataagaaataggatcatgttcgttttctacattgtctgtttcctcccactgcaccagttctgtcagatctctaactgagccaaacaagatgtcgcaataaggtaacattgaatgataacgcttcttcatctgttctttttttccatcttcttgattcaaactaggacgataattgaaatcaaaacaaacttttttccctgctttatgtgcttgttctgctaactggatagctgtttcagccgtctcatcagataagcttaaactgatcccgcagatatggatcaaatcgatctcatcaataaatgctgcacagtcataatcctctattacagataaaccaaatgagctatgttttcggttttcataagtgacttctgtcggacggacaccataccccatttctgcaaaataagtcccgatgtgttgatattgatggatcacatacttcgtttggatacctagtccgttcaaattagtgagtgctgcttttcctagacgattgtctggcagagccgtcagtaaataactttcaacaccaaaatgggcaaggttccctactagatttacgccagtccctgtgtaagccatgcgtaaggtatgggtttgttccagcatcaaatgttctggaggcgtgagtcgcagcatgacttccccaaatgcaccaattttcattcttctcaccttattccacgatttttttcatcaattgcaacagttggcgtacctcttctgggcgtgtattacctgtatccttgtcgataattgcactatatacatgagggatgacctttttcactcctgcgtctattgcgatccgtacgatttcttccacattatcaaggtcgatcccaccagttggctctaaataaaaatcattggcagcacaagcttctgctaaggctttatattctttgatatgaacaagtcccttcataggaaaatatttgattgagctgccgcccatatctttcaacaatcgaatagctgtttcaagtgtcacgactcctgcaggtccttgtgaacttaaaggaccagttgcgatgttgacatatccttcttttcccgtgggagaaaccaaaccgttgatgactgtttctgtctgtttcaatacagctcgggaagctcctactcctgtaaagacttgattgacatgctgaggctgcaatacttcggctaaacgagtgaccatctggctctggtttgggtctcccgcgcctagaccgatagataaggcattatttgttgcttgctggtattttttcatttctgcaatagctgtttcgtcgtcagaaaagttctttgaaagaacccctaaaacaatatggccttccgcggcctcatagcattcttttgcgttttctacagaatttgctaacacatttagacatatcttatcttttaaataattgggacttaatctcattcctttttctctcctagttcttcaagatttcttttaagcgatcgatgattttctccatctcctgttgattgacggaacggatatcaaattcaatgatgccgttgtttgcctggtattctcttgtatagatggcaggatttttttctttcaatgctttaatcacttgtttagctgattgatctcctgaaactttcacacttgctcgatagatttctcgacctgcgctatcttgaacgattttagcttccaaacgatcgatctgattgagttgttcgatgaacggttgtagtctttctttcattgcaaggccagactcactgcctttattcaaatagtcttccactgcttggacaaaaccgaggatactttcctttccgattttcatagaacgtccgattccttttgattgcatccgaacccatgaaacataagttttttttccaatcaccattccggcgcttggtccttcgatcgcttttgcccctgaataaataactagatcagcgcccaactgcacatattttttcagatcttcttctgccgcagcatcaacgattaacggaagctggtgctttttggcaatctgtgctgcctctgacacgtcaagcatacttttttgtaccgtgtgatggctttttatatagagaatccctgctgtttcttctgtgatcatcatttcgatctgttccggcgtacacatattagcgtaacctgcttcgactacctgaccgcctccttgctgtaccatgatttccacagccgtgccgtaatctacattgtgtccttttggcaaaatgatttgtcgttttttgatggattctgcataaggatgataaaggggatacagttctcctttacctataacagcagctaccgattgagcgattcctgcagatgcggatgaaacgatctggacatcttctacttctaacaaatcggctaaatattttcctgtttgaatgcttaattcttccatctcaaaaaaatgctggccaccaaaacgttgcgcgtcaagaactgtctctgagagggtcgagactcctagaatcgtcattcttcctgaagcattgattacttttttcagctgaaatttctcatgattcgcatgcataactttttcctccgataatcgtttgtactggtttaatttgctgatttgactgtcttttctctccattggaatcgattagttccttaggttgattgatcaattcaaaaacagtaaaatcagcgtcaaagccttctttgatttgtcccttcgtcttcaagtgaaaattctgtgctggaacttccgtcaccttttcgatgatttcttcccacgtatatccgacaagccgcaatttttccattgttgtggccaaatcgtagactggaccgtttttacgattacgaatatagatgtctgtgctgatcgtatctgcttttatcccttggtgataggcggtttctgcaacttggaaattaaaactatccgtcccgtgtccaatatcgaagatgattcctcgattttttgcttctacagctatttgtttgatttttttcgttttctgttccaagatcccgtttgtttttccattgaaacaatgagtcataatatctcctgattccagtaaagctaaaatatccaacaaatttggcggagcagaaccgatatgaaccatcaaaggaagctgatggttttctttttgtatcctttttgctagctgtagcggagtgatgccgttttgacccactacgctcttgctcatccgtgctttgagaccaataatgaaatccggcagttcctcgattttttgctttaccatatcagcttggatcttgtttaggtctgctagttcatcttgtgcaatgattccccattttgagatattcaaaagcgcatagacatttgtttttgcctgtttagcatgttcataaaaatcagcaatgttttctgccccagtcgtccccgcatcgatgactgttgtcacacctttattcacgccgatttgatctggataatcataatacagggtcatttcttcaaaacaatgaacatgatcgtcgatccaaccagccgacaaatattgctgaggggtcaagctgattttctgacgagctttttttgtgatgagaggtgcaatttcgcagatctttcctttggttatcccgatatcgaaggtcatcccgttaaactttcttgcatttttaatgactaaatcatacataatcattcctacttttctataaatttgaatttagaccatggatgaatgaatggcagcaagatcaattcttcttgaataatatgccctactttattctttcgcggatcactgtggggctctaaaacgatttgcagctcgtttttatatttgccaaaacggtcatttccaacgacaacatctcctacgacaaattcaaactcggtatcatgtgctttgttttcatatttttgatatttttttcgaacttccgttgatcgtatcacttgatctgtgatgtcccctcgacgaacatgctgctcttccaatacgatttgccgttccacctcatttatatttgcaacaaactcgaccctaaaaacagtctggtaacgatccaaatgccctaatgacttcaattcttcttcacttgcgtatgcgtttccaataattatatcatcaattagatttgtggcaaacaaatgcttagctgctgtttctacagagaaatggcgatgcatttctaaagtaggcagtccatcattgatatcccatggtccgattctacctgattgtgaggtaatgaaggctgccgttcgaataccgttttttttgaatcgttcactactagattggaaaaaatgatacggtaaaccggttccttcttgcggataaaaattgtgacagccatatagaaaagatgtattcgcctgatgtgtcaagatattttctagataagcgacatcgttactcatattcaactcgatggccaattgataaggattaaaagtcaaaagtgcttctttttttccatcaaatcctaagtctaaacgaataccatctgctcctaatttatggaagaatcctaaatcgtcataagaaatattcagttgttcaaaaatagcgggcgaaacatctaatatcgtttcaaatcctctctcttttgcaaaaaagatcaattgctggaattttttctgaacaacttccggatcttccgagatttcaagcatactcataaaaatcctgctgaatccgtattgatgggctgtttcgatatactcacgatctttttgaggatcactgtggtctgggtaaagggaaatgcctaatgaacgtttcatgatttgttctcttctttcttttcaattatagtcgttcttcggtgacgccatctgtcagagtgagatctgcttgctctttcgcttgctcctctgcttctctggctaattgctgtttttcaaacactttgaagaatggataataaatagccaaagtaatcaagaaattaccaataaccaataatcctgctgcaatactccagttcgtgctcatccaagcagcaatcggcgcaggcatcgcaaatggcagacgcgcaaccatcattggcacgacaccactgacagtgagaatataagacagagtcgtcgtcacaagaggtgcaagaataaatggaattcctaaaactgggttcatcactactggtgcaccaaaaatcattggttcattaatattgaacaatcccggcagaatggacaaacgtcctaagctttttaaatacttggatttagaaaacatgaataagacgactaacgcaagagtggttcctgctccgccaatccaaacgaaccattgtagaaattgttcagtgaaaatattcggcatggcgttagcacttgtccctgcattaaacgcatcaatattttcagcaatcgaaatatcccaaaacggacgaataaccggacccatgatcgctgggccatggattcctaatacccagaagaaacaaatcaggaagacagtcaaaagaccgccaaacaagctgttacccgctaatacaccttttaaaggcataagtagttgactcaagaatccatttaaatcgaacccaagcatatggcggatgatccaaaagaaaatcaagataactgctcctggtatcaatgccacaaaagaatttgttacttccggcggtacaccatctggcattctgatggttatttttttctcaataaaaaaccggtaaatttctactgaaataattgctgtcacgatagctccaaataatgagcccgatcctagattagcaatgttaatgtaacgtccggctgtgacttcccccatatcttctaaaatacgtgtaggaggagctgctacgatcagaaaagacattaatgccaagatacctgctgttagggaatcgagtcgatagcttttcgtcaaagaagaagctatcccaaatgtcgcataaagagcaaggataccaacagtatagcgaaaaggaatatctaatatctcacggtatggctcaatgactgctgcaactgattcaattgggatgttcagtaaaattgtaaaaaatgatcctacgattgtcagtggcatagtggcaatgattccttttctaatggcagtcatatgtcgctgagtaccaatacgattggctacgggcatgattttttgttcgataattcctataaatttatccatcttctttctccttttataacattataatgtttacaagtgaatagtaacacacttctctgttaattgtaaacgcttttctaacaatctctccttcttttgctgttttctttttagaaagaaaaggagatatgacaaaagtcgtgccacactcccttatccagaataagtggtaatccagaaacagccgtgtatctgcggtaataagtccaaccaattcaaaaacatgaatagctgttttttgaaattgttccttgtgactcggagctgaagggcaagctcacgacctcttggtaaacggtgttcaaaagccagtttctcggtattaagccaaatttatgcaaaaatgtagaaagccattttcacaaaatttttcttaatactcgaaactaagcgactttttcacaacctcttccttaaacggtgttcaaaagcttacatctgcggtaataagcctaaccaaacgaaaaatatgagaagctatttttgtttggctgttcttagtacttgatgcagggcagctttttcacaacctctttttttatttatgtttcataatcaatatggtaaggatgcagatacgtatggtagaccgcctccgaatattcaatcatttccccaatttgcgtagacgatttccgtatccgtttgatgccgatctgtgcgtttgttttcagaattccttgttcttcttctgttaaaaatactgcagagaaatcatcagaaaatgagtcaatagtatatccttttttcgtcagcaaacgatacaaagattctttgccaaattcttctctgctgaattgcatcatttcttgtggaagataatggacaaaataaatataaggctgattgttcaaataatataagcgcttaaaacaaacagcttgctcaccgaaaaaggaaaacaaaggatcttccttctttatattgaccaattgcaaatccagcgtttctttccggacttcatatcgggagttctccaagatttgcgtaaagcttgccgctttggataatcgattgtaaggacgattgcttagaaccgtcgtcccacgaccacttttcttttcgacatattcatctgatgccagcagttcgattgcctttcggacagtgattttgctgacttgaaacagttcttctaattcactttctgtcggcaacatcgaaccgactggatattttcctgagaaaatatcttctttaattttatctgcgacttccaagtatagtacacgtgtccttttcataacgtcaccctttgctttactattactaaaagaatagcacataaaaaataaaaaaagaacacaaatcacatgtgagaagtgtgttctttttcattcagctgctttaattacaagtttacgccatttgaggcaattacttctttataccaatcaaaagattttttctttgatcgattcagtgtcccatttccttcatcgtctagatccacatagataaagccgtaacgtttactcatttctcctgttgatgcactgacaagatcgatacatccccaaggcgtatagcccatcaaatctacaccgtctgctactgcattagccatcgcttcgatatgacgacgtaaataatcgatccgataatcatcaataatcgtgccatcctcttccatatgatcaatggctccaagaccgttttcaacaatgaataatggtttctggtaacgattgtataattcattcaatgcgattctcagcccttctggatcgatctgccagccccattcacttgcctcaagaaacggattttttactcctcccagcaagttcccttctgaagttgctgcttgaggatcagtctcattgattgccgtagacatataataactaaatccgatgtagtccactggatattcttttagcaactggaagtcttcttccgtttgctctaatttttccggatcgactccatattttttatgggtacgcgctgtgtatgcagggtattctccacgtacttggacatccgtgcagaaaaaattgaattcttggttttggatcattgttgctgcctgattgactggattggcatcgatgctgtaagttgttgcatagataatcatgcagccgatttggatatccgaacgcaattcgtggccgatttttacggctttgctacttgcaacgaattgattatgccatgcttggaaaatattttggtactctcctgctccattgctttttactaatccttgacttaaagctggaaagtgaaaggccgaattgatttcattgaaagtcatccaatatttgactttactgctgtatctctctaatactgtctgagcaaatcgttcatagaagtcgatcagttttcgatttttccagccaccgtattcttttgccaaatgaagaggcatttcgtaatgagaaatcgtgatcacaggttcaatatcatattttaagcactcatcaatcagctgatcataaaattctaatcccgcttcgttaggagtaccttcgtctccatttggaaaaatccgtgtccaggcaatcgaaaaacgataacatttgaatcccatttccgcaaacaaggcaagatcttctttgaaacgatcgtaatgatcgattccgcgatgattcgggtaaatatatttttcttgatcaatcgtccagtcaaattcttcactgccgataatcgcaaagcgctgcttacctccaggcatagcatctgcaacggataacccttttccgtctcgatcataagctccttctaattgattggcagcggttgcgccaccccataaaaatttttctgaaaagcgtgattgcatcctgatttcctccttattttacaattgctagaacatcttcgtttgcaataatctctttttggtctaattcaagtatatcggcaaatgcatcagtattcgtaatgacaactggagtgattacgctatagccagctgctctaattgcttcgatgtcaaaacgaatcaataaatctcctgctttgacgagatccccttgtttgactaagatctcaaagccattcccatttaattctactgtatccatcccgatatgaatcaaaatctccgctccgtcagtcgttgtgatccctacagcatgtccagttgggaaaatagtcgttatctctccgtctgcaggtgcaactagttctcctaattctggatcaatagcgataccttttcccatcacgccagaagaaaaaacttggtctggtacttcactcaatggcagtactttacccgttaaaggactttttaaggtatgccgtgctgaagtaatcgtttctcctgcattcgcatgtttgttttctaattgattgtcttgtgtttgttcgtcaaatcctaaaatcaatgtacctacgaatgcaagaacaaaagcaattcctgtagctattactgctactgtcacatttgactctacaccatccaccgtactaatgaaagtcggaattgtcaataagctgaccaaactgctggagaaagcttttactccggaaaatccgataatagctccaccaatacctccagaaatacaagcggcaatgaatggtttcttcaaaggtaatgtcacaccatacacagttggttcagtgattccaaataacgaagtcactgtagaagaaatccctaatgctcgaagtttcgtatcttttgttcgcaatgctacagctaaagcagccccaccttgtgccaagatggctggaagaagcattggcatcaatacatcaaacccatattgttcgatattcaagaacatgattggtacgaatccccaatgcatgccgaacatcacgaatacttgccataaacttcccatgattagacctgctacgattggactaaatccataaatcgagttgaagagaccgcctaaagcattaccggcaaccgtcccgattggtcctaaagcaagaaatgttaatggaaccatcactactaaaacgacaagcggaactaaaatcatttgcagaaattgcggaatcactttttttacgaatggctctaatttactttgaacccataccgctagaatgattggtatgacagaagaagtataaccagatggtgaaagaatcactgggatcccaaagaaactgatagcttctcccgcaccagcaactgctgtgatagctgggtacacaagtgccatagcaattgctactgctaaaaactggttggctttgaactttttagctgctgtaaaagcaagcatgacaggtaagaaggtaaagacaccatctgctgcagcaaacaatatttgataagtaccgctatcagctgtcagccagcccatcaccgttgccaatgacaagaatcctttcaataccccggcggctgccatcgcccctagaaaaggtgtaaatatactagaaatgatatcaattagacgattcaaaatatttttggactcttcttttccatcctccgaaactgcaagaccttcctcatccacgatcgattgataaacatctgctacattactgccaatcactacttgatactgaccgccactttggacgacttggatcacgtccgggtcttcttttaacttttgcgtatctgctaaagattcatcttttaatctgaatcgcaaccgcgtagcacaatgtactaaacttttgacattcttttgtcctcctaccgcttcccatacacgacgaccaactgcttgattatccattgttttttccttctttcttttttatttaaaaaataaaaacccagattgaaaaaaacagtcacaaacattcgtgaacctattttttcaatccaggttttgcctgccatacagtaacaatccttatgattggatgctttttttctcacttactactctttgaatatgaatcgttaaataaatctgctctgcgatccccatttcctgtttttgcgtttgtcgaagatactcattgatccgttcgacacaatgaaacgcttttggatactttccttgaactaatgcgtagagaaattcatcttgttcgtcagatccttcccctttgagataacgctgggcaaaaaactgcagatgagtaatgatacgctgataattcaaagattcttcatcgaacacgatgccgaagaatttactgatgatactcagtatatctcttaccattgtggtagcggtcatcgtcacttgcatgtcttcgtttccttgttggctattcacaaaatgaaaggcaataaaaccggcttcatcctcagaaagttccacacccgtcttttgtttcacgaacaaaagagcctctttcgctgcttgatattctttcggataaaatttttttgtttaaaataataatggattaggcagttgaatattttcttttgctcgtgtgatcgcataatgaagatgatcggtcaatgtcagataaatattaggcgaaaattcaacttttagtttatcttcagccagttcgactacttgcttgacccattcgatctcctctgccggaatatcagccatcagctgctggaattggtttttagcaaaagaatctcttaaaacaaattctttttggacagcttctggcgaaatctcgtccccaatctttttttgaaaggctagtccttttcccatacaaacgacttcttccccgaatccatttttcgaaatgacgacgttgttattcaaaattttatcaattttcattttgcttcgccctctcaagaaaaataaaaaaacctagaattcgcctactgtttcttagctgaattctggttttgcctgccgtacagtaacaatccatttcttattcaaaatcatcataccatcgaatttttatttatgcaagccttttcatataaaaaataaaaaaactggaacacaagtctatctagagaacaaccaaatcagagatgcacctctttgcgttcctctttttttcagcaaattggtttttccttatcgattcatatcctttggctgtttttaatctgtaacgacttatgtcccagtatcctaaaatgtttttgtctctagattgaaagcagatctcatatcatctgtcgcatcttttatcggtgtaacactttccagttctccttgtacaactagtcgcgtgacggcatccatgtcgccacaagtaattagtgtgacaatttcttttccctcgacttcattcagtaattgggtatctgtaggagcaactttttctttaaaaaatgttttgtatgtatacacattttctaaatctgtcaaatagatcttggcacccatctctaaattttccagcggtgtaaacaacaattcagggttcgttgcacgatggcttgctaaggcataatttccttttcccatttcttgatctggagataatgttcctgctccgtaaagtagtgacgtattatccaagcctttgaaaatcggtaaattgattgaaactgaagggactgcgatactagcaatcactggtagatctgttcctctcatctgcgacctcatgaccccttctgtcgtcattggttctaccgcatcaaagtcaaaactgacatctttatcgttattctttttcagatcttcttttgttacattcgctatagcatatttatctcctgtctctctgacaagataatccttgatctgttcattgaaaatcaaagctagtcctactaataacaagaggaacaagaggatattgactagccatctttttgcttttcctttttttttcattttctctccctccagactcattttactgtttttcttttgctctttccaacagccgaatgacacatttctacaactctgtgtatttttttcgtacacctgcgcttttttctacaggatatttcaaattatttttgatcaatttttcttcaatgatctcatctagatccagctgaaggttgtctgccatcatgtatgaatagatcaatacatctgccagttcttctttgattcgttctaattgtgtttcttttacttcttccggcgttttccattgaaaaagttctaacaattcagatgcttccaatgaaatagagatagccaaatctttttcgttatgaaattgtcgccaattacgttcatctctaaactggttgactttttccatgctattcatttgcttgccttcttccaatcatttcttacttgattaatcataccatttttttacataaaaaatagatgatgcttttaaaaaaactcctgttttcttttatttaaaataaatgtcatagaaaatcagtaatttaggtagccaccatgtgtatgcagtaatgtgacttcttcccctgaggctttttgtttttcgatacgttcttctccccaaacagacatcgctactagaatctctcttaatgattttccttcttcggtgagcgagtactctactttaggcgggacttggttatagacttttcgatggacaatgccatcttgttctaactctcttaactgctgggtcagcattttttgtgtgatcgtagggattttcttgcttctccacgcctaaaataagcgatattgctcttccctttatctggtgtaagcaaagcagttagcattttgacgatcgtgggttccgcttttcacttcttatctacttagtatcatgaagtatactttcgtactaatactaagtagcgaaagtgtcaactactttgtttaactacatagcaaaagaaacagaagggtgacaacggtcatcacgcttctgtttcttttgaatatgctgtgttgttgtctctatctccgtgtagactttcctcaagcttatcctttgacagtaagtcagtaggctgatttgctctttctagatgccagatacatttctacaaagaaacagtgattctgctttgaaaaatcgatttttagttctgcattttcgtaaacatccagcatttttttcgcactgtatagacctaacccgccattttttttagaggtttttcctcttttgaccatctccgatagcgtcaaattcgttggatttgccttgttcgctatactaaaacgtaatccctctttttcttccagcagattgatcgtaatcggactctgatcggctacacgatgatcgaatgcgttagaaataaaaatagataaacagcgaataaaaacaaccagatcaatcgggattgttttcacttcgacaggaataactacttggatcgggattttctccgattctgctttttctagaaattttaaaaagacacccctgacagctggggatacaatatttgttagctgttgtatttgcggtttttcaaaaatagctgcagaatgatcttctaagatttctaaaaattccaacgtttcttttttattttcctgaagaataatttttaatgaaaacagtagacttttataatcatgtttgaattcctctagatgatggtaatattcttcatttatttgatacagttgaagcgattcctgatgttgtctttcttttacttggaaactgatcaacataatggaaaaaaacaaagaaaaaaaactgatgactatcgacaaaagagatagaagcagataattagatgagcggaagtgaacacttcccaataccaagtaaatcacgccccagcttaataaaatacaaatacctccaaaatagtgttcagttggataagtaaaaagcaagttgagaaatctcgtctgtttgtctatactttttactaatagatagaaaataaatgcgataagtagtgcaaaaaaacttgctgttccaagatgtctctttcctaaataatccatcagatcaaaaaccagaaaaaagctgagtccagtgatagcaaaaaaaagattactgatcaaacagctgataaacaggtttttcgtagtaaaataaaaaagaaacatcaataataagccaactaggtaaggaaagctcactttagggataggaagtaaaagtgtcaccaccatcaaagctatacaaccaaagctgttttttactagcagttgtttcgaaaagaataaatagatacctaaatctaaaatcaaagtaaaggtcaaataaagtgtcactgttgcgaccatcttattcctccattgttttgtttcaaaatgtacacatatttttttaataggagcctgcatatgaaaaagtattttatcatagaagataaccagtttcacagcgaatggatcatcaaagaattggtcaatcatcatatcgagaatatcgtgcagctcacttctgtctctcaaatcaatcagttgatccagttgggcactattgataatcacgatgttttctttatcgatatcgacttgaagcaatcactcacaggtattgatgtcgccgaacaaatacgtaaaaaaaatgcacatagtaatattgtttttttcaccgcttatacgaattttgcagtagagatcatcaatcggaaaatccttccgattggatatatcagaaaagacaggaatttatctgaacaaattcgtcaagtgctagaacagatcaattggaaagaacagcagatcgtaaatgtcgataaaatctttattgatcaaaaaggtggaagtctcgtcctgtatcctcgggaaattttatatattgaaagtatcaaaggtttgaaaaaccaagttatggtcaaaacaactacagaagataaattagtgaatacttctttaaaacaattgaagacagagttagaaaagtatgcttactttttactattaaaatcttactgtatcaacttatcgcaattgcagaaaattgattctgctcattatgtgttagaatttttcaatggtgactccttactcgttggtcgaaagatctttgaaaagacaaaggaacgtttccatgacttccaaaaaactgcttcgagttgatgaataagagctgagacgtaagcatagcagacttcagggagtaggccttgaatcggctccactccctgaagtcattgatttgattttacgctttcccttctgtaggagcatctgttaacgaccatgtgaatgttgaaacgtagttgtctacggcataattggatacaggaacaaataattccactgattgtctcccttgttccacattctctcctaatgaataaatccatgtgccaatcccttcatttgctcctgcagttactagatctactgcctgatctgctgggatctcaattccttcagcgccagtaccagaaatagtagatggcgttccactgctattagttgcgctatttcgaatcacggcgtttttgaatttcacctttgaaccagttagtttattcgtatcagatgttgtaccaataaattctgttcgtttgactgatagtttccaaccggcataatttccgcttttatccgttacttgtacgaaattctgtacttgtgttgctgtccctgtactgtccgttccgttttgtaatgcagcatatactgtttttgctgtacctaacttgattgttccaaaatcaagatctggagcttggtcaatcgtcagtaatccggatgttccctgatttggttcgtcaggtgtaaacggcgtatcgggatcatttggatcaacaggaggaactggaacaacgtcttcaggatttgcggcatctggttttgttacagaaatcgttccttctgtagtggctgagctcttattctcagcaaaaacactttgtgtacataataatagacttccagctagaacggtacttaatgcaattgtttttttcatttctttttccttctttcttttaaaataaataatccagcaaataagccaataagaatgactccaacaaatatcagccatcgccagtcaaatgtttctggctgattttttaaatcaatatccttttcattcaattggtccgctgcatcatcagttatttcaaaatcggtatggagattccagcgtttttctttccaagcacccttcacaaccgcttgataatgtcccggagctaatttttttccttctaatgggacaagtaaatcaaaatttgtattgggtgctacatctattttttctttttttattgaaaggtaaggctcttttgtttcttttttgtagatttcaaccgatgtagtcaagccgaacatataagaagcatttggattttgaagattcgccttaatcacatttcttccatcgctttgatccgcataagctttttttaatttcaaatctggggaagactctttttcgctatttcgaatcaagattgctttcacttgagaaaactgattgacgacaccaactgtacttttgttagaaacgttctcttttttttcttgaaacgtgatccctcctgcgaccacaccagccagctctttttctggcgctttcagtgaaagtgtctcagtgaccgcactttgaggaggaacagttatttctcccactgtttttgctaagtttttcatatcataacttaatgtttcatcaaatttactttttgattctccatattcgatcacaccgtttgaattcgtcgtagcggagtggatcaatgtctcaactgttactgatttatctgttcggttaaagaccgtgtaggggatttcctgtgttttcccaggctccatccttacatttatatatgttttgttcttatcaatctgattagccggtaattcaaaatctaccgcaaaattgaattcggaggcatggacaggtgtctgccaaaggatgaatccaaggagaaggatcagaagtaaagagcagttgtttcgatgacttttattccatattcgattcatcaatcatcctccttgatctttattctgtcggcgcatctgctaatgtccatgttatctctgctgagtaattaccagctatctgattttctttggttaagacaagtttaaacgcccgaccgttatttaaatattctgaataatctgcttgcacattcgttgaattttgtcctctgacaatttccagttcttcttcattcactaattgatactcctcagctttcttgaaatataggacatcctgcatagaaaatcctgcatcatttgtgaaaggctgagataattttatcgttaagatccatggactttttgtttctcgctgatcataaatccataatttttcctgcccatccatttggccaaatgcttcttgtatcaaaccagttgctttgatctgaccaaaatcgagtttggaaggggcaagaaatgagagaccaccttctactacgatcttcgtagcaggtgcaaaaggcggggcatcatgataaacaactggcgtatcacttggattgtgattcccaatttcatcgttggtacttggcttgttctgcacacccttagcagcagcttctcctgcttggtcgtttaatacaatttctaatacatctcctgcaaaaagttgattttctgggatagaaagaacaaatttccctgtatcatcaatagttgtttcggacaaaacagcttgattttttttcaatgaaaccaaagctcctgcttcacctgtacctgtgatcgtgcgagaagctgcattgatcaatgtggtacttaaattagcaggttcagggggaatcacatcgactgtcgttttggaagagtccagttctgtcacttcttggccgcctcttacttttttagcagcaactacttgcacttgatcccccgttgttagtctttcttcgttgggtacttgaacttcaaacaaaccgccttgttcgccttctccccacggattatatcctgccccttcattttcatctgtttgtccttgtgtgagagcagtaatttctacaggtgatttcgtcgtatctgcataagtaatacgtaaagtcacttctacttcgcctgtcccagcatctcttggctttgcctcgacaccttcgggaacaacgacatgcccatagattttttcatctgcattcgttggtactcttaaggattcaatcatcggaagctggttattggcactgattcgattataatttttcattccggcacctgtctgagcaaattcatttgttaaacctgcactagggcttgatacaaaattacctaagtcggttccattgatcgataagtctgtcatatcagaaaaataatccggatctttttcaaagttatcgaacgttgctcctgcctttcgccataaagcaatttctgaatgagcgatcttcaatgaagaatcgccatttccttgaaatacccagccacctatgccattagtctcgcttccgatccgtttgttttggaaatcgaaataggtaggagattctaagtgtacattcaacacatccccactgatgatgccagtcttatcttccccagttttcccgaccatgactaaataagttttttcgccagccataaagttcaaatcaatatctccagttgtatctacggtagctccggaatctgcgcgtatatcgatatttgatttttctccagtaaccgtaaaatcagctgaccctggactttctagaaaaccagaagcgtcataaaattggatcgcttggtttccttgattgagtctgttcacataagatttgccatcccctgcatttcttaccttcagtgagcctccattagttactgttagtttttgcgtaccgttctcaaaacgaactgcgctagaacgaccactttgcttatcaatatcgatgactgatccggctccttctacgatcaaagaaagtcctttccctacaaaacgcatcccattgtttccaggttggtcgccatctccagccattttaaccgagatttgtccaccacttgatacatggatttgactagaatctccttgcaggcgaaatccgccagtagtcgctgtattgattgtgattttcccatcattcgacacagcgactcttgatcctgagcctctcatttggataattccgcgattgttgtcgttggtaatattgatctttgtatttaccgaaaattcacttcctgagccactgacttcaaatgtgacattcccgggtagcgtatcgacagcctctccttcatcgctgacgccatctgcccgatcatagtcaagagagacctttgaaccactcaagatatggagtcctggtgctgtttttccactgcccgtctcatcacctgaatctagaaaaccatagaattttcctagatatggtccataaagctgactaccattgattacatttagctgatagcttctacaaaaataagctttacccggagcggcattcatcccttctttcactggttggacatccaatacaccggaaacaccatctaatgtgacagttgcacgaggggcgtaaatcaggcctaatttagaaccatcatataagtcaagtttcccggtaaattttatttctcccgtaaaatgatatctgtttccccaaaaatcggacatataagcaatgataatggcatttccatcgatatttggtatcaacccacctggatgagctgccgttcctttaaaattctgaaactcgatcgactgaggtgtctcattgatatagatgtgatgtgtgccgaaattatgagcaagtccgccaaaatcgataacgatatctcgcttgatctccaattccctgtctaaagtcaaaggctgagttaaacgaatcttagctactgattcgtctgcgagaagctgcgtcagttcttctgttgtggcagcttcgctgtacccatccgctgaaacaactctaacctgtacctcttcactgctatcagacgtttgttcagctacttctgaggtctcacttgtcttattttcttcttgccttgtattagaagtaggcgcctcactttgggattctgtagtttcagaagtaattaattcttctgaaaaagtagtcttgtcaaaactttgattctctgattgcgttgattcgcttgttttctctacatcggcaaaaacggatgtcaccatcaagagagggaagacaaacaaaatcgacgcaatcagcttttttacatattgattcattctccaccatcctctctgacgttttgacaattttattttaacgttttaatttatttgtaattgtactttcatatttaaaatatgtatttttatggcaaatttttctgttaggtgaaaatttcttttttgtacaaaaacatactaagattagaggggaacatcattgacgaatgatgttctcctctattttgagaagcaattttcgtaaattccttcttatttcttgaagctgaccacttctgtcacaacctctttttttaataatcattctaaaaggataaaagttcgttttttaagcgtttttataaaataaaaataaaaatcattcgattttatttgaattatgtatctattattgatacaatggttcaggattaaataatatagaacgaggtgttcacatgtcatctgtagtagtagtaggtacgcaatggggcgatgaagggaaaggaaaaatcacagactttctcagtgaaaatgctgaagtgattgcacggtaccaaggtggcgacaatgcagggcatacaatcaaattcaatggtgtgacttataaactgcatttgattccttctgggattttttataaagacaagatcagtgtgattggaaacggcgtcgtagtcaatcctaaatcattggtcaaagaattagcttatttacatgaaaaaggtgtagaaacaagtaatctgcgtatttctgaccgtgcacacgtaatcttgccttatcatatcaaattggaccaattacaagaagatgcgaaaggtgaaaacaaaatcggtacaacgatcaaaggaatcggaccagcttatatggataaagccgctcgtgtaggtatccgcatcgcagacttattggataaagaaatttttgaagaacgtcttcgtttgaatctagatgataaaaaccgtcaatttgtaaaaatgtttgattcagaaccacttgattttgacgatatttttgaagaatattatgaatatggacaacaaatcaaacaatacgtcacagatacttcggttatcttgaatgatgccttagatgcaggtaaacgcgtgttgtttgaaggggcgcaaggagtcatgttggatatcgaccaaggaacctatccttttgttacttcttctaatccagtagccggtggtgttacaatcggaagcggtgtaggaccttcaaaaatcaataaagtcgtcggcgtctgcaaagcctatacgtcacgtgtcggtgatggtccatttccaactgaactatttgatgaaacaggtgaacaaatccgcgaagtaggacgagaatacggtacgacaacaggacgtcctcgtcgtgtcggctggtttgattctgtagttatgcgccattctaaacgggtgtcaggtattaccaacctatctttaaactcaatcgatgtattaagtggattggaaaccgtaaaaatttgcacggcttatgaattagatggcgaactaatctaccactatccagcaagcttgaaagagttgaaccgctgcaaaccaatctatgaagagttgccaggctggtcagaagacattacaggatgcaaaacacttgcagaactgccagaaaacgcacgtaattatgtacgtcgtatctcagagcttgttggtgtacgtatctcaacattttctgtcggacctgatagaacacaaacaaacatcttagaaagcgtctgggcgcaaatctaaggataaaaacgacgactgaatcaggacgttcttaccagagcgagtcgaagtgtttatctatacgataataatcacttgaagaggtagtgaaagagacgtttagccttattgccgataggctgtctcttgaacactgtttattcagaataagggactgtgacaaaagtcttgtcgcagttccctttttttgaataaacggtgttctcctgccaactcctcggccacaagtcacaatattcaacaaacatgagaagctgttttttgaaattgctccttgtcactcagagtgaaacggcaggttcacgacctcttccttaaacggtgttcaatcagctgaccctcggcattagctcaaaaaacggcaaaatatgaggagctatttttatttggctgttcttattacttgatgcagagaagctttttcacaacctcctaaacggtgttccagaagtagcttctacggaaataagccgaaatttcacaaaaatttgaaaagcaattttcgtaaattccttcttatttcttgaagctgaccacttctgtcacaacctcttattttgattagaacttgcgaaaataaaccggttaaagtgtgtctagcgcaagagatttgctataatagatgataagggtaaaatgtaacgagaaggggttgaaaaatgtgtatcaaattgtaacagattcttgttgtgatctgccataccatgtattagcagaagaaaaaattgattttttatcaatgaatctccaattgaatgatcaagagttagtagatgatctcggaaagacattcaattatgaccgctacatgaatcagctgaaaaatggtgcgatgcctacgacatcacaaatcaatgttggccgatatttagaatttttccgttcttatgcggaaaaacagattcctgtcttatatgtggctttttccagcggattaagcggctcttacagcagtgcgcttcaagctgttgaattactgaaggaagaatatgaagtccctgagatctatgtttttgatacaaaagctgcaagtatcggggaagggcttttagtattggaagctgcaagattgaaaaaagaagggaaaagtatcgaagaaaccttagagtggctggaaaaaaattatttgaaagtccattcatgggtaactgtagacgatttgaagtatctagaacgaggcggtaggatttccaaagcaagtgctactctgggcagtctattgagtgtaaagcctattattacggtagataaagaaggaaggctgacgaatgttgacaaagttcgcggaaggaacaagtcgatccagacaatcgtcaatgagacggtaaaaacaatcgttgcgccactcgatcaaatcgtttatgtggcttacgctggggatctagagagcgcggagaaggcaaaacggcttttggaagagcagataaagatgaaagatgtgaagctttatcccttaggaccaacgatcgccagtcacacaggctatggctgtatcgcgattttttcgatgggaatcagtcgataaaagcagtaactcattctgtaaaaaagcccaggatttgaatgtaacaaaaatagcgactcttaaaagatagatgagcatcctatctcttagaggtcgctgtttttttgttttttaagctaaatagaccgttacgcccataactcattcaattgtttttgaatatctgtgttttccaagaactcatcatatgtcgtatcagcccgatcaatcacacctttatctgaaacagcaatgatccggtttgccaatgtttggataaattgatggtcatgagaggcaaacaggatcgagccagtaaatgccatcaagccatcattcaatgcggtgattgattctaagtctaaatggttcgttggatcgtctaatacaagtacgttagctttcgaaagcatcatttttgagagcatacaacggactttctctccaccagataaaacattcactggtttcaatacttcttcaccagaaaaaagcattcttcctaagaaacttcttaagaaggtgttgtcatcttcttctttgcttgcatattggcgcaaccagtctaaaatcgttagatccgtgtcgaattctttcgttgtatcctttggtaaataagaatgacttgttgttactccccaacgtactgttccagtatctggtgtaatttcacccattataactttgaatagtgttgttgttgttatatcattttctgcgacaaaagcaaccttgtcttctttgtttaaattaaaagatatatcatctaagattttctttccatcaatcgttacacttacattttctacctgcaataagtcgtttccgatctcacgttcaggtttgaatccaacgaatgggtaacgtctagaagaaggctggatatcgtccaaagtaattttttcaagcatttttttacgtgaagttgcttgttttgattttgatgcattcgcactaaagcgagcaatgaattcttggagctctttgatttgttcttcttttttggcatttgcattcgcttggagtttagccgctaattgactagattccaaccaaaaatcataatttcctacataaagtttaattttaccaaaatccagatccgccatatgtgtacatactttgttcaaaaagtgacggtcatgggagacaacgatcacagtattttcaaaattgatcaaaaattcttccaaccaattgatcgattggatatccagaccgtttgttggttcgtctagtaaaagaacatcaggtttaccaaatagtgtttgtgctaacaacacttttaccttttgtccgccagtcaattcactcatttgctgatggtgcaattcttcagggatgttcagaccttgcagtaaaacagctgcttctggttctgcttcccatccattaagctcagcaaattctccttctaattcagctgctcgaataccatcttcgtcagtgaaatcttctttcatgtaaatcgcatctttttctttcatcacttcatacagacgcttgtgccccatgatgactgtttcaagtacagtatagtcttcatagtcgtaatggttctgtttcaatacggccatccgttcatctggtcccatagtaacggaacctgtggaaggctgcagatcccctgataacactttaaggaacgttgatttacctgcaccatttgcaccaatcaagccatagcagtttccgggggtaaatttaatattcacatcatcaaatagtttgcggtctgaaaagtgcaaactcacatcatttacagtaatcaatttttttcctcacttttatcattattagtttttgacaagtcttatagaattatataggggaaaggtaaaagattcaaggcaatcgaacattctttgtgtttcacgtgaaacagaatgaagaaaataaacataaaagaggagtagaaatagctgctataggattttttagtttgcaacagcataatttttgacgttatttataagaaggagtactataaaactgtaaaagaaatgaaagaaggattgaaaatggatgaaaaaagaaccatcgactggggctcattgattttgggaattttatttgtacttgtctcattgttatcatttcaagaccctgtcggaaatttagttgcaattgtagtagtctttgcgatttttgcctttattaaaggaatatttgaactgtttgtacgtaatagattaaaagagctaacaggatataaaggaaagatgcccttaataatcgggatcatcgatattctagttggcgtctttttcttattcaatattggtgcaggagtcgcagcattaccttttgtttttgcagtatggtttattgctgattccgttttagcgttatttactgctgacttggcaagaggagtaagtgaaggatattattggtttacgatcatcgtcaatattttaggaattttattaggaattttcttattgtttaatccaatttcttctgcgttgacattaagctttttagttgggttctattttatgttattcggcatcacacatatcgcctatgcgtttagataagtgaaatcaaacaaataaaaaagccagcttccggtaacagtttgactgttgcaattggtagctggcttttttatcatggacaaatatgcacgaggtaatctttaggtgtcgagacaaatttatgcaaaaatgtgaaaagtaataggcacaaattttatcttaatacttgaaacataccgcagttgtcacaacctcttgatacacggtgttcaaaagcttgcatctgcggtaataagcccaaccaaacgaaaaaatatgacgagctatttttgttttgctgtttttattacttgatgcagggcagctttttcacaacctctgatacacggtgctccacctgctgcttctcggtaataagatcgccgtcctagaaaatatgaggaactattttctgtccatcgttcttattactcgaagcatagcgcagttgtcacaacctcttttcatataattcattcaatactggcaaatcatggacttcatatttttctttgaatgcttggatttcttcttcagaatattttcttggatctaaatgaagatcttctactggcaatggacgcttgttattgattttcacatcgatcactacaggacggtctgattttgcggctgcatcaaaggcaaaccgaagttgcgagtattctgtgactgtaaagctttttgcaccgagggcttctccaactttaccgaaatctgcatcttctaaaaatacaccgaatttcttttgttccgtatcttcttgttctgcttcgatgaaaccaaaagaatcattagaaaaaacaacattgataattggaagctgatatttgacttgtgtaatgatatcttgcatgaccatagcaaatccgccatcaccacttaaggtaaatacttgtttttctgggtagcttagttgtgcggcaattcctccaggcacaccattacccatagttgcgaaccatccagaggttgtatgtttttgtttaccgttcatatttaataagcgaatagaatggatagtcgtgttaccgacatctgtgacgaaaatcgcatcgtcttcagcaatccgattgatttctttatagacagcctctggtcgaatcggttcttcctcacgatcttcaaaagatttcaaccaatttacccatttttctttattttcctgatttgctaggtaccagctatcagcaggacgagcatcacctaattcgaccagtctttgcaaagctgtgtttgcatcaccgagaatcgacagcgatgtttcatggcgccgtccgaattttgacgcatcaatatcgatttggataaattcagcagttggattaaaaaatgcacgtccaaacgggaagtcgctaccgacaaataagatcagatcggcttctgccaatgcttcatttccgggtttagtagcgacacgtccagcaaaaccaagaaagttttcataatcatcaggaataattccttttgctagaacggaagcgacaataggaactgaaaaatgttctgagaattctttgatttgcggaaatccgtttcgcgttccttgaccaacataaagaactggtttttttgctttttcaagataaggcaaagcagtcagcaaatctttttcttctggtaatatcacacttgttttgtgagtgtgagcagtagagaaaggttgttcatcaatttcttcaaaaccaagatcaacaggaatagtcacgatagccacacctttatgctcataggcggctttaatggcttcatctacgacatgtggaagactttggggcgtcatgactgtacgattgtatacgctgacatctgcgaaaataggattttcgtttaattcttggaaagagttatagttcatggatgtagaagcaacttgtcctaagaacgctactagaggcacatggtccatctgtgcatcatacaaaccattgatcaaatgtgtcgcaccaggtcctgcagagccgaagacagcgccgactttcccggttaattttgcatctgctgctgctgctagtgcaccgacttcttcatgacggacttgaatatatttgatttcgtttttttcgtgatatagcgcatccataatcgaattgaaagatcctccgggaatgccataaatatggtcgatgccccagctttcaagaacttttaccattgcgactcctgcattgatttttgacatggtgtttcactcctttagcaatgatgatccataaattttttgtatctagagtatagaactttttatcgaaaatcccaactaattcgtcttttcacaaaaatatagtcatgtttttgggaatatgctagagtagtacataaatagattcaagagaggggaatggcatggttgaatggctattgaggcttgatccttggcagcaagcacttgctgggacagctttcacttattttatgacagctcttggtgccggattggtttttttctttaaagaaatcaaaaaagaagtgctaaatttgatgttaggatttgcttctggtgtcatgattgctgcaagtttttggtccttgctcgatccagcgattacaaaagcagaagaaaatggagatattgcttggctagttgtaagtattggatttggtttaggtggggtgtttttatatatggcagataaaacactgccccatatgcattttggaccgcaacatgaagcagaaggattgcctacccatctaaagcggacaatcttgcttgttttttctattacattgcataatgttcctgaaggtttagccgtaggggtagcgttcggtgcagcagcaactgcggataatccgacagccgctatactagccgctgtttcggtggcgctaggtattggtatccaaaacttcccagaaggagcagctgtatcaatcccattgcgacaagaaggtctgagccgtaaaaaggcctttgtttacggacaagcttctggaatcgttgaaccaatcgctggggtgattggcgcactactagtaacgaaagtggagctgctgcttccttatgcacttgcttttgctgcaggagcgatgatttatgtcgtggtggaagaattgattcccgaagcacagcagacattgtctagcaaacgtcattttgcagtttttggtgttatgagcggatttatcattatgatgatcttggatgtagcattaggataattgggaaaattcatatatgatatatcaaatagggtcgcgaacttatgtcgcgaccctatttttaagtaagttatatcataacggagtgatcatgtgattcattaataatagttttttcgatgtgtattgcctttgatccaacgaacgagccagatgataagtgcgattggaatcaaaattttgaccgcaaaccataaaaggccacttacgacactaacaaaaagactgatgacaaagctagcggcaatcaacactaaaagaaccatgaagatatttaagaacatatttttttgacgcatacaaaaccctcctcttgttcattctttactatagaaaaagtataacagggattctctaaaaacacctccaactgcagactgatttttacttcatctgcttaaatgatcaaacaattgctttttcccttgtttatcatctaaaatagagcggaaaaggaggagaatatcatgcctaaaaatcgtcttgaagcatttacagatgctgtaatcgccattatcatgactattttagttttagaacttcatgaacctaacggagatacgtgggaggcgctcgctgcattaggttaccgattttttatctatattgtcagtttcatcatcttagcgatttactggaacaatcatcatcatttatttcaagttgtacataagataaatggacgggtcttatgggcgaacagtttctttatttttgcgctttcactttttccatttgccacttcatggatcagtgagtacatcaatagtctggctccagaaatgacttatggttttgttaccttgaccgctaacattgcgtattatatcttggcaaaagaacttgtcaaagcaaataagggtcacgagaaagcattgaagacgatgctgaatgattacaagaaatcatacttatcgattggcttgaatgttttaggaattgtcttaggctatttagtagcgccagtagccgtgctgatcgcaaacatcgtgattcttgctgcttggatcatcccaagccgtaccattgaatcacaatatcgataaaatgatccatgtttaaaatttaagagaaaaatatagaaaaaataaacaaacgatcaaatatccgagtgatactagtattcaaagagggatgcagatggatcaaaaaagacttcatgtaggactgattactagttttatcacgatgcttatttatttggatcaaggtcatttgacttggacagtagttggtgtcacggtattcttgacattattcgcagcaataaaaaaataaacatctttatgtaagctaatattctatctatttaataaaaacatgtttacagcagaatcatactgctgtaaacatgtttttatttgtggaaaaaatttttaaaaaagtgtatcgaaaaaaatcgttagtttttccacagtggataactttatgatagctaaaaaaacaatagattagttaaaggaggcatatagatttcttttgtcaagggatatacaatagaaatgaataaatattaacgagaattcagatggggttaaaaaagtaaattcagaagagtgaaaaataacgaaccgactatatttttagtgttattttatagttaaaaaataacgatacacttgttttgatttctctgctacttctaaaaactgctgctttttcctttgaaatgtcttcaaaaagtaggatcaggtaaaatctactggcagaaatcaaggaaaaagataccttcataagagagaaaaatgatagaaaagaagaaaaattatttatagaacaagctttttacaataaatagatatacctatatggggtataaagaagaacgaaaatttctcaatcgatttaagtgtcgaataggaaaatgttaagatataaagcatttaagctaaaaaaataatcatttttgattaaaatgcgtacttaatttatgaacggcttatggtaatacttgtttttcaaggaaaaggacatttcattaatagaattaatctgaaaatagacgtaaccgttactttactattttttgataaaaaaacaaagggaaacatatcctgactgcttcaatgtgtaagatgtacactccaaatggtagaggtgaaaatcgatttttttgagaatcaataattgaataaaaaaggactgtcataggtacacactggaatgtatctgtgacggtccttttttatgaacgattttatcgaagacggatagtacgtgtcaaaaataaaaaagctacgattagaaataacaataaaacgtaccccaaaataacgactaggcgatccaacttatttgtcgataggtgtttgtttaaaagctgatagaaccataatccaatcagacctcctgttgtattagtaattacatcagtgatatccgctacgccaataccgaataggaattgaataaactctgcgaagaagcttacaaggaaaatgatccctaattttttagaaaaggaaagccctttgaaattgacattcaaaagcaccccaaaaggaaaaaagacaatcaagttataagtggtctcgcgcaaaaccgtcgtattttcaaaagaaaaagtagaaaaagggacgagattgacattgctataagaataagtgagaaattgtggaagattaaatgacagcttgaataaaatcaaccataatagaaagaataaataaatccctaataaaaattttgatacataccgcatagacatctcctccatttaaaaagtataccatcgaaaactgctgaaaaatcataaaaaagtatgaagtttaaggaccaacgtagttatcgtacgaaaattagaagctttttttgttgggaatccggtttcttttaaatgagtctaaaatgagaaaacgtccaaatatataacttaagtaatttttattcgttcactttttcctctcaaagattatttttaataattatataaactacatgcatatatatattatttttcgtataaaagtgagatatgctatacatgaaaaaattatggaaagataagtctttcaacacttttttcttcggattcattcgttttacacttattgtattaatgatatttacttttttattttcttgatgataaaaagaaaaagttagataattgcatatatagttatatatataaatttcagataattcgaattattttgctgaatcaccttgacattgcttaacgccaaatgtattatttcaataactttcattatcttttaattatttcaggtgatttattaattaaatatgttgcgcaattatctggttaataggggttgaaaagggtgaaagcagtataaataagagggggatatacattatatgaaaaaagttttagctttgcttctagtaagtgccgttatgctgggagcatgcgggagtaatgcaaaagggtctagctcttcaaagaaaagtgaccttgtatcagaatatagttctgtatatgtaacagatcttgaaacgctagattacacattctcatcccgtaaaacgaatagtgaccactatactaactttgtggaaggtcttttggaaaatgaccaatacgggaacctgaaaggcgatatggctaagtcatgggaagttagtgatgacgggttgacttatacgtatcaccttcgcaaaggtgttccttgggtggatagtgaaggaaatgagtatggggctgatgtgacagcaaatgactttgttactgggttgaaacacgcggtagatgtacaatcagaaacgttatatatcgtggcagatagtatcaaaggcttatctgattatatagatggtaaaacgaatgatttttctactgttggggtaaaagcagtagatgactatacgttgcaatacacattgaataaacctgaaccattctggaactccaaaacgacttacggtatcttatatccaatcaatgaagagttcctaaaatcaaaagggaaagatttcggtaaaccaacaccagactccatcctttataatggacccttcatccttgcaaacaatacagctaaatcagttatcgaatatacgaagaatgaatcttattgggatcctaaaaatgtccatttagacacagtaaaatggacctacaatgatggaagtgatcccgatgggttatttaaatcttacgaaaatggagaattatctcttgctcgtgtttatccaaattcaccaggatataaagacgtaacaaaagcttatccagatggtgtgacttggtctcaaacaggtggatccacatacaatttaacatttaactttaaccgaggtacatttgatgcaacttcaaaaacaacagataaagaaaaagaagatacacagaaagctattttagaccgcaatttccgtttagctattctattcggatttgataagaaaagctataacgcacaaagtgtaggagaagaaggagccactaaagcattacgtaatacacttgttcctgccgattttgtagaaattggcggaaaaccttacggtgatacagtggcaagtaaattaaaagcactggattccgatgcttttggcgatgtaaatttatctgatggacaagatgggtattataacgcagacaaagccaaagaatatatggaaaaagcaaaaacagaactagaagcaaaaggtgtgcaattccctattcatttagatatgccagttgaggaaacttctgagattagtgtcaacatggtcaaatctttgaaaaaatcagtggaaacttctttaggatcagataacgtagtggttgatgttcaactattgaatgaagataaatatttagctgctacttatcaagcgacgaccggacaagctggcgactttgacattacaaatgcctctggttggggtccagactacactgatccatcttcttacttgaatatctatgattcacgcaaaggggatatgatccatacacttggactggaagcttctgccgtagtacaaggaacggatccatcaactgctgcgaaaaaagcaatcaacttgtctgaatacgacgcattattggataaagccgctgctatcactgatgatttagatgctcgttacactgcttatgcagatgcagaagcttggttgttagataatgctttgcaagtaccaatttatgcagatggtgggacgccgcgtgtcacaaatgtagtaccatttagcggaccatatggttgggcaggtattgctgcaaacaaattgaaatatgtagaagtacaaagcgatatcgtcacaacagatcaatacgacaaagcgaagaaagcttgggaaacgaaaaaagaagaaactgcgaaagaagcagaaacaacaagttctaagtaatttagctgaatgaatagtaaaaaaggctttcaatttctattgtagccttttttacttatatgatgaaagagagggaaaattgtgaaaagataccttttatttagggtcctgcgctctatacttagtatttttcttgtaactaccttaacctatgcggtgatctattcacttgttccgagaaaaacgatatttcaaaatgatgtgaattacggaaaattaaaggcaaaaccagatgaactggcagattatgaaaatacagcattcagcaagatgggttatatcgaataccacacgacgaaagaactgaaaaaagaagtaggaagcagttcatcagaaaaagcctcttctgagcagttagaagaaaaataccaagattgggcgaagaaaaatggttggacgctcaaacaatttccaatcagcaaagaatattatgcgacaaaagatattccattagtaaaacgcgtagtgaatttctatgcgaatatgatccaaatcgatcacccatggaaagtaaaagatgccagcaatcctaacttaaaacattctctgcgtatcgaaaacgatgagttggtcggttgggcacttgtcggttcaggaacacaatataaataccaaatctatttcaatggacaatttccttatatccatcaaaatatcgttcatttgaatctaggcacttcatatccgacatttgcgggacaagcggtaacaagcatcatctcaggaggacaagggaaaacagaaagtacagagacaacatttaatgatgattttacagcgcgctcttctgctaatatctatctccgtcaatatcagaaaacaaaaaacatctcttcacgagacaaaaaatatttttctgataattacgtcatcacagacacgaatcaccaagacccatcgatgatcggtacatcatttcgtatgggagctatcgctgttattattgcttatgcgatcggtatacctgctgcgatgttgatggctcgttacaaagggaagataccagataaagcagggatcgctatcgtaacggtgctgatctccgtgccaagtctagcctttatctatttcttccgatttattggaagcagctggttttctttgccagattccttcccagcattgggcgcacaagatattcgctcctatatattaccgacagtgattctaggactattgtctgtttctggaatcgttatttggctgagacgttacatgatcgaccaacagtcttccgattatgttaaatttgcgaaagcaaaaggtttgaatgcgaaagaaattgctagaaaacacattttcaaaaatgcagctatcccaatcgtcaatgggattccaggaagtatcatcggagcgattgctggggcgacgatcacagaaacagtgtttgctgcaccaggtatggggaaaatgctacctgatgcgatcattacccataacaatccattagttatcgcaatcgtttttgtctttaccacagtatccgtattttcaatcttagccggggatattgcgatggcattagtcgatccgcgaatcaaactatcgtcaggaggaaaatagcttggaaaatgtgaaaacagaacaaatgaacgaattcatttttgtagaaacgaattcgttagcttcagaaaagattgatacgccgaagtattcgtattggcgttcggtcatgcgtaaattcttttcaaacaaagttgcgatttttatgctgatactgatgctggctgtcttattgatgagctttatccagccattattcagcggatacaaatttatggatgtaaaagatatcaatgactttacgaaacgctataatccaccaagtgcaaaattttggtttggtacagatgctaacggcatgtccttattcgatgcagtttgggcaggggcgaaaacatcgatttccatcagtgtcattgctacattgatcactacagttattggtgtagtagtaggggcgatttggggaacatcgaaagcaattgaccgtttcatgttggaaatttacaacatcatctcgaatgtgccaactttactgatcgttatcgttctctcttatacgtttggttcgggattttggaatttgatttttgcgatgtgtgtgacgagctggctgagcgtagcttactttattcgggtacaagtcatgatcatccgcgaccgcgagtataatttagcctcaaaaacactaggaacaccgaccttgcggatgatttttcgtaatatcctgccttatctgatttctatcatcgtgacagatgtatctagagcgctaccttcgtttatttcatatgaaacctttctttcattcttaggcgttgggttaagcagtgatgttccttccctcggacgattgatcgcaaaatatacgaataacatgagcaattacccttatcttttctggattcctgtgactgtactggcgttagtttctgtttctttatacatcgtaggacaaactcttgcagatgcggcagatccaagaacacatatttaggaggcaaacaatggagaatcaaacaattttatcagtagaaaacatctcggtcagcttccatgttcgtcaccgcgaattaaaagcgatcagaaatgtctcattagagctaaaagaaaaagaaacattagccatcgttggtgaatcaggatcaggaaaatcagttctgacaaaaacattcaccgggatgctggaacaaaacggcaatatcacttcaggaacgatccgctataaagacaagatattaagcgaattgaaaaaggatgaagaatgggaagatattcggggaaaagaaatcgcgacgatcttccaagatcctatgacttcactgaatcctatcaaaacaattggctcacaaatctcagaagtcatcatcaaacaccagaagaaatcagcgaaagaagcgaaacgcttagctgtcgaattgatggaaaaaacaggaatccctaatgcggcaaaaagatatgatgaatatcctttccaatactctggtgggatgagacaacggatcgtcattgctattgcattggcttgtcgacctaaaatcttgatttgtgatgaaccgacaaccgctttggatgtaacgatccaagcacaaatcttggaactaatcaaagagcttcaggaagaatatcaattcacaacgatttttatcacccatgatttgggcgttgtcgcggctatagcagacaaagtagctgttatgtatgctggacagatcatcgaaagcggaacagttgaagaaattttttatgatccaaaacatccctatacatggagcttgctttcttctttaccacaattagcacaaaaaggagatgtgctttactctgtaccaggaacaccaccttctttatataaagatatccaaggagatgcttttgcgcctcgcagcgcctatgcgatgaaggtcgattttactagtgaaccgcctatgttccaagtatccgaaacccattttgcgaagacttggctgctggatcctcgtgcaccgaaagtacttaaaccaaaacaaatcgaaaatcttcatgaaaaaatgattgctttggctgcagaattggatagtgaagagcaagacggggggaagcaagttgtcagctgataaaaaaactttgttaactgtaaaagatttagaaatcacttttggagaaggaaaaagcaagttcgtagctgtccaagacgccaactttgatatttataaaggagaaacgttctctctcgtaggagaatctggttcaggcaaaacgacgattggcagagcaatcattgggttaaatccgacaagcaaaggggatattctctttgaagggaaaaagatcaatggtcccttgtcgaaaaaagaacaagcagaaaaaatccgtaagatccaaatgatattccaagacccatccgcatcgttgaacgaacgggcaacagtagaatatattatctcagaaggtctctataattttaacctgttccactcggaagaagaacgtttggaaaaggtggcaaaaatcatcaaagaagtcggactacttccagagcatatgtaccgctatcctcacgaattttccggcggtcaaagacaacggatcgggatcgctcgtgcattagtgatggaacctgaattagtcgtagcggacgaaccaatctctgctttagatgtttcgatccgtgcgcaagtgttgaacttactgaaagatgcacaaaaaaaacgagaagtgacatatctttttgtcgctcatgatctatcagtcgtacgttttatttcagataggatcgctgtgatcagacaaggacatattttagaactagctgaaacggaagagttattcaaccatccgcttcatccatatacaaaggcattgctttcagctgtgcctataccagatcctattttagcaaggaaaagaaaattacatgtgtatgatcctagcatacatgattatacaaaagacggtccggttttcgaggaagtacgccccggacattttgtatacgggaatcaaaaggaattagaagcgtatcgaaaattgtgagatctgcagtttgactggacaccgaaagtcaggtgatcaaacatgatagttaatcgatattttggtaaaagcaaggggaagacagagaagtcttaccccttcttagtccacaaagggtggatgaattggaggattgtttattttgtaaaatagtgaatggaagattgcaccgaagaaaaatagttgagagtgaaaatattcttgtatttttagataacgcaggagatgtcgatggtcatatgatcgctctagtcaaaaaacatcgggtcaatttaattgattgcgagcaagaactatttattgaattgatgaacgtcattcgagcggtttctcttcattgcgtcgaaaattgcggttttgatggcgtcaatttgatcaaagcagaagatgagacagtagaagaacatgtctctcaccttcatttccatattattcctagaaaaaaacaagatggggtggatgcttggcccttatttaccggcgcgatgaatgatttagagactatgcaccagcttcttgatatgagacaaaggacaggagaaaaatccagtgcataaaagagaagaatgtacgctcttagatacgattcattcggtttttaataaaaaaagataaggtagcgagttgcttagaaaacttgctaccttatctttttttgttaatacgactcgaatgttcgttctttgttttgacttttccaagcctttttcttcttgatactaattttatgaaaaatcaagaaataattgttatactaggtaatgctgacaaacgggattggtatttcattttgattcagcttcttttcaaatcactaggaaggagggatagattgttcaagacttattttcgtttcaataaaatacaagataatccttttcgtatcatgaacctgatgctacttatctttatcgtattatggttaggttacataaattatgactttttgatttcaagtttttcatcattagggatctttacttttttctattatcaaaacataccgatgaaatctttgctgaaacgtatgtttttgatcggttgtggacttttgtttgctttcgttctagggattttgtcaacttatgttttatggcttgaaccatttgctgtagctttggttgctttttccagcagattcgtgttgcgattattccatatctctaaaccaggtggcttgttttttgcgatgctttctgccatgggaacgagtatgtagctgccaatcgctcaattaccgatcgtctcgctttatttttttatgggtgtcgtttttgccctgattgcggcagtgattacaaaattactggattcacgacctgagcagacaattgaaaaagcgactctaaaagaaaggtttcatgaagagcctttggtgatcattgattctgttttctacagtgccgccttgtttctgtccgtttatgtcagtcatggcttgaatctgcataatccttattggttgaccttgtcatgtgcatcgattttgctggcggaaaatttagatgcgatgaagcatcgacaagtccaatatctgattggatcgatgggtgggttatgtgtgtcagcagtcttgtcatttgtgccgttcacgcaactgcagacgatttttctgattacgtttctttacggaatcgcacaatttctagttgctagaaattacgcagttgctaatatttttcttaatcccatggcgttgatgctatctacacttattcgcggggcctatctgatgtctttgatcgaatatcgttttttaggaatcatcataggaagtttcatcggtttaggtgttgcgtgggtaatgaatgtcgggctgcaacattatttaaatgtcgttcgaaagaaattagaatagaaggacaaatagaagtatatgtgctaaaaaaggttgtgaaaaagtcattttcacaacctttttcttaatactcaaaactgagcggctttttcacaacctcaattaatcgaatgatacttcaaagcggacagaagtaggaaattccgcaatgatttcgtttaatatagttggtttcacgttttttacctcttgtctgtgtttctaaattggtcgcactttttcttctgatgcaacaattttatgtctatccgagtgagctacacgtttcaaaagatagacgaaattgatttgctgataggttttatctgtgttttcttcaattgaaaaggtactttcaatgagggcaagcaaacggacgatttttgtttcataaccagtttcctccagcatctcgcgaacaacggcttgttgacttgtctcaaaacgtttgaccgctccgccaggcaatacttggatgccctgttcattgttttccctgctcaaaagaatagcatctgtttcctcattccataaaattccagatgcctgtatatcaaattgaaaattctcttctaccatacgcaaatcatttgtttccattccaacgcccaccaatctttttcgcaaaaaaatttttatatttattttatcatcaatttttgtttatgttggcggctgggcaaacttttttgagataatcatcgctttacttgaaagtcgtacagatattcttgctttctccatagtgaaggttctacacgtcgcttttccgtaagagacaagctacttaggtcgagttcccagatgattagattattatcatgatcatggctagcaatcgctacgtgttcatcgtcaatcacggagacaataaataccccactaagatccatgtttgtcgggagttttttagtagtttctgcagtctcaagatcaataaagtagatcgtgccgttacttgaaaagtaaacaagctgatctttataaataaaacttccttttgaaaaactgaatcctatatcttccagtattatttctcggtctgtttctttaaatgtatacgatgaatctttcagcgaatagctaaataatccagctcgccgattattagcaaaatcaaaagccactccgtataagtggttttcatgaacatttagccgataacctatcagatattcactcccttctatattggggaacgaaccaaggttctcactgataagcgtatcttcagaaagatagagtctatcaacaaataattttcctatttcttcgtcacgtaaaatatagagagactgctcatcgtttccagtcgaaaaaatatgcccgttgataatcgtatagtcattattaaaataaaacccgtggtgctagttaattttttcctagaggaaaatgtctaaacatgttggtaaatcaacaaaaaaacgcatatagtagtctcaaaactcccaagaaatgaggactaatagcgagaaggatacacctgtaaccatgccgaacacagaagttaagcttcttagtgccgattgtagtgaggggttgccccttgtgagagtaggacgtcgccacgctgatgttattccggcatagctcagttggtagtagcgcatgactgttaatcatgatgtcgtaggttcgagtcctactgccggagttctcattttgagaaagagtattgagcttctttcactctggagagttgtccgagaggccgaaggagcatgattggaaatcatgtagatggtgcaaactgtctcaagggttcgaatcccttactctccgtaacaagtttacctggcccgttggtcaagcggttaagacaccgccctttcacggcggtaacacgggttcgaatcccgtacgggtcattttaattgaatgttggaggtttagctcagctgggagagcatctgccttacaagcagagggtcagcggttcgatcccgttaacctccataatgaactggttccgtggtgtaggggttaacatgcctgcctgtcacgcaggagatcgcgggttcgattcccgtcggaaccgtcgttcttgttattcaattaataattttaaaatatggcgcggtagctcagttggtagagcaacggattgaagctccgtgtgtcggcagttcgattctgtcccgcgccaccatggaggagtagcgaagtggctaaacgcgacggactgtaaatccgttccttagggttcagtggttcgaatccactctcctccattttataggggcatagtttaaaggtagaacagcggtctccaaaaccgttagtgtgggttcaattcctgctgcccctgccatggcgaatgtggcgaagtggttaacgcaccggattgtggctccggcattcgtgggttcgattcccatcattcgccctttttattcttggggtatagccaagcggtaaggcaagggactttgactccctcatgcgttggttcgaatccagctaccccagttattcttttaatttgccggcgtggcggaattggcagacgcgctggactcaaaatccagtgcccgttgagggcgtgccggttcgaccccggccgccggtattacgaaaaaccttgaaatttaatttcaaggttttttatcttatttaaatactgttttataaacccatagatcagtataggaacagtaaagtttattaggtttgaaaaatttttttgtatagaaaaaagaacctgtattaaaaaataataatattttctactaaaatatattgaaataaaatttcataattatataattaattatgaacattctttgcttcatcatgcagtgaatgctttctattttattgaaaaggagtggttttagtggaaaagctgatgaaatgggttgaggaaaaacttgtcccaccaatggcaaaaattggtacacagcgacatttattggcaattcgtaatggggttgtttcaacactgtcattgattttgattggtacattttttatggttttcatcaatttaccgtttcctgggtggaatgaatttattgccccttattcggcaacgatcgttttacctttcaggattacgatgggattaatggctatttacgcaacttttgttatgggttcggatctagctaaatcatatgggttggatagtgtgacgggtggtatattatcactagggacgttctttatgttacaagttcctgtaaacgttttaacacctgaagaggcacctcttggctgggtcttaccgatgagttctttaggagcatctgggatgtttgccgggatcctatccatgatttttgcagtggaagtgtatcgtttctttaaaaagcgtaatattactatcaaaatgccagaacaagtaccacctgctgttgcccgtagttttgaggcattgattcctggtgcagtgattttaacaacgacttggttgattcgaagcgtcgcgggctttgatgtaaacgctgccttattatcgttattcgagcctttaaccaatattttagggaataatctgcttggtgttttattaccaatgtttttgatccatttgttgtggtcatttgggatccatggcatgagtatcgtaggggctgtcgttcgcccaatgtggctgattatgttggatgagaatgcgaaggcgttagcagatggtacagctgctaccaaattgccttatattgctcctgaacagttttatcaatggacagttacgattggcggtgcaggagccacgattgtggtatcagttttgtttttattcttttgtaaatcaaaattcttaaaagaagttggtcgcttttccattattcctggtatcttcaatatcaatgagccgatgatttttggagctcctatgatgttgaatccttatatgttcattccattcaacttagttcctttagttttgactattgtcagctattttgcagtcaaattagaaatggtcaatggatttactgtgttgccaacatggacattaccagcaccaatcggcggctatctttcagcaggaaatgactggcgtgtggttgttttgattgtgatcaatacactgatagcatttatcatctattatccatttgtaaaagcttatgataaaaagatgttgtcagatgaacaaaataataatggagataacgaaatacaaactgcttaggtctgatttcagaggtggaaaacaatgtattggctgattttattttttgtttttatctttttattaacgataagccaacttatgttgaatatgctggctatgcatcaggttcacatcaatcggtgggtttgggcactggcatcatttttgattgtgattcttccaaagatcattttaccgcagataaatgttttattatcatggggtacatatatactttgtggaatttttactatcaattttatgatcgagcagcataggtggtttgtcacatcgaagctttaatcgaagctttaaatgttccaaaagcaggcttgtaaatgcaagcttgcttttttaccgttgtatcaagaacaatagaccatactccatactaactaagtcgtttcttttctttccgttctgccattatataaagtttatgattgctttaaccgatttggcagaaagaaggagataaaaatgagcgatttatcaacaatggatttagaattaatggatgctgcaaccgaagtcattaaatcaaatattgatttggtgtctttcaatcatacagtaggagctgcagtacgttgcacaaatggtaatgtgtatactggtgtgaatgtttattcgaatcatggggcatgtgcagaaatcattgcgttagggacagcaatcagtcgtggtgaacgtgattttgagtgtatcgtagctgtgggtggagatcattctgacatgatctattctccatgtgggaattgccgacagtttatattggagtatgcacctgattgtgaaatcattgtctcaacagaagagggggttaaaaaaatcaaaattacggatctcattccatatgcttaccacagatcagaatgatttttatacgaacagattctctttttattttcaatcaacagaaggtttaatgatgttggatgaatgattatcggtatacaaggagatgcagtgtcatggggaagctcgtcatattaagaggaaattcagcaagtgggaaaacaacgacagctaaagctattcaaaatcattttcctatggggaaggtgatgcgaatctctcaagatgaagtgagaagaggaatgttgaatgtcaaagataaaataggaaatcctacaccagatttgatccgtcagttggtagaatttggaaaagacagatttgatttagtccttgttgaggggatcatgcgcacaaaaatctacaaagcgatgcttatggacctgtatgagagctttcaaggaaatgtatttgcttattattacgatctttcttttgaagaaacgctgagacgtcacagccagagaaagatgtcaaaagaatttggtgcagaacaaatggcggagtggtggttggagcacgatatacttggattgcctaatgagaagatactgactgccgaattaagtcaacaagaaatgatagagaaaatacttcaggagattgatctgcaggtagacagttgattttttatcaagaaataattggtgataaaaattaaaatttttattctgttctaaacaattatggttgtttagaacttttttttgtgtatgatataaaggagaaataattttttaaagggaaggaaattgttttgataaaagtagatggagcattactgaaagaataccgaaagaaaaaggggttaacccaagtacaattagcagaaggtatttgcgaacaggcaactgtcagcaatatcgaaaacaagaatatgtcaccaggtatcaacatcctaagtgcgctttgcaaaaagttgaatgtcgagatctccgatatattagtggaaacagaagaagacaagatcagaaaaaaattaagtgagattcaatcgttgaatgctgtatcgaagtacaaagaatcttatgaaattttacaaacggttgatcagaaaaaagtaagcaattctgatcttttaaaccaaatcttgttttatcaaggactgcttgatcatctttatgcaaaaaaagaagatgcagcattgttttatttcaatcaagtgttggaacaaacgaccgaaacagatatccatcacttacaagcagctgcaaatgtggcaatgatctacttggcaaaaggagaattagactttgcaaaagtgtatgtggaacgtacgcttaaaatcttgaatgatactgattttgataatctgatggtctgtgccgtatattataatatcgctacctattacagcaaaatcgagaactatgaaaaagcaatccagttgtgcgagaaggggatcgaatacaataagaaacataaatcaacccattcattggaatacttgttttatgaaattgctttttgccataagcaactaggagaagacgattatttagaaagatatatggatgccaaaaaagtagcatgtttcaacgggaatgatcacgcggtgaaagtgatcgaaaacgaccttaaataaagaggtcatgacagaagtgtataactttaagaataccgttgattcgaaaaaaaagagatgtgacaaaaacttttgtcacatctctttttttatggcttaatttcgattgcagccgccgcttcaaaacttttcaacatacgatctagtccatctactaatttcgatttcggacagccgatattcaatcgtaaaaattgatgaccgtttccgccgtaaatcgatccatccataatcgccactttgcctacagaaatcagcttctctcttaaaagaggaatatctgatacagctttggatacatccagccacatcaaataggttgcttcaagatcgacgacttttacatctggcagtttttcctggataaatgtttttacataccgctgattgctttcaagataatgattcagttcatctacccaatgactgcaataccgataggcactcattgtcgctaacataccgaaaatattggtagaagataacccatccgcattttttaactttctttgaaaatgctcacgtaacccaagattcggtatcaacgcataggcaaatgtcaatccagggaagttaaatgtttttgtaccgctggtgacaatcgccacttgttcataattgaagcgtgtgataggtatatgcctttgtcctcgtcctaaaatgtccatgtgtatctcatcagataataaaaatatagaatactgacggcacaatgccacgattttttctaattcccattgtttccatactcttccggttggattgtggggagagcagagaagtagtactttgttttctggcctggctaatttctcttctaaattcgtaaaatcgatccggtactgattttcttcatagatcaaaggattctcgactagaagtcggtcattgtcttggatgactttaaaaaaagcatcataagctggcgtttgtaaaaccactccttccccttttttagtaagcatttgaataagggtagatactgcatagataactgttggagtgtacatgatccattcttcttccagtagtgtgtcaaaacgggattgataccactgtttaattgcttcttttaattcatgatgattccagcgggtatagccaaatactggatggttcatcctttctttcaaagttttgagtacttcttttgggaccataaaatctgtatcagaaatcgtaaaagggagtaaatcagcttctccaaatcggtcttcaacgtagtcccactgtgtacagtacgttccttttctatttatagcggtatcaaatgtcacaaaattcaccttctatctttttatcctaaaatcgtatcaagctgattgcgaacagttgtgacttttgttccgataatcacttggacgttttgatgatcgagatggaccacacctaatgctcctagttgttttaacttttcatcatctacgatatctgcatctgctaaaactaaacgtaaacgtgtaatacaattatctaaagattggatgttttcttgaccaccaagtgctgctaaaattccttttgcatcgtatccgcctgttttatgaaagttcacttcttgatcggtatattctgtttcatccactgtcttgtcacgcccaggtgtttttaaatccaattttatgattactgttttgaagacaatatagtaaataccgaaccacaaagcaccgattattaatacccaccaccattttgtgtcattaccttgaagtagaccaaaaatcacaaaatctaagattccaccatctgtattcccgattactacacctaataatgccatgaccataaaacctagaccagtcatgacgacatggaagagccataatagcggactaatgaataaaaataaaaattcgattggttctgtgattccggtcacagctgtcgcaatcacacctgaaatcaacaatcctttgattttatgtcgattttgtggtgctgcggtacgatacatagctaatgctgctgcaggcagtccaaaaataaatgtaggcatttttccctgtgataaaaaggcagttgcacttggcgaaataggcaaattgttttgcaattctgcataaaagatattcagtgcaccaaatacttctttcccatcaatgatcgccgaaccaccagcttcagtaaagcgtatcatcgaaactagaatatgatgaagcccgaatggaagaagcagtcgttcccctgagccgaataagaagggaccaaatattcctgaacgttggattagctggccgatagccataatgaccatagcgaataaaggccaaatcaaggggatgatcaaaccaacaaaccctaaaactagagaagtgataatcggtacaaaacgagcccctgagaagaaggcgaaactatctggtaactgaacagtataaaacctgttatgcaacttataaacgatgattccagcaatgatccctccaagaacacccatttcgatcgtctggataccaaaaaccattccttgtccagcttctcgcaagtggtcggcatcaactaaacgatttgtcaggactaagtaaaagttgatggctaaattcatgacagtgtaaccgacgaatccagagaaagcggccacacctttttccttacgaactaatcctaatggaatggccatggcaaacatgactggcaagtaggtaaaggcaaaaccgccaatagcagacatgaattggaacactgctttgactgctggatatcctaaaaacggtaaagtctgaatcattgattcactggaaaatgaactacctaaccctaaaagaatacccatgaaagctaacaaagcaaccggcaacataaaagtctttcccaacccttgaaagaactcccaaaaggtcgatttctttttctttgtatccatttttcttcctccatctcttagtagttttaagatcttaaaaaaatgattgcgttttcattgataggtttattatagctaactaaaggaaataaaaaagaggagacagatattctgtatcctcatacatgattgagtaagcagtttcactagaaatagcaataaattatagctaattgtttttcatttggtctgcatacatcaagagtactgtatcaaataaacaaatcacagaaattcttgaacttaaatcgacactgtggtgatagcgagtcgttccctttgcatataaggaaatcgtcgataatttttccaagttacttcccttggttgaaataatactgatgatagggacttgttgtctttgagcaatctgggcataggagaggataccttttgtttctcctgtgaaactgacgaaaatagctaagtcttcctgatttaaattacttacagctgcttcttgttcatcccaatctgaacgagcaaatgctttttttcctaaaaaagtcagttttcgagcaaaatctgtacaaatagggaagcttcctcctaatccaaaaacttcaatagtattcgattgatggatcaatgtcatcatttgtttggccttttcttcgctcatttgatggaacgtttctgtaacatttgaagtgatctggttcgtgattgtttgaaagcttcggctatttccttcctgttcctctacatggatggattgatcgatggcgtatttcaactctttaaaaccttgatagcctaaatgtttagccgttcgggagatagtagcagttgagacaaataaatcatcagatacttcataaatcgtttttgttccaatatcggacaaatggaggaatatataatccaatatttcattttcgattttacttaacgaggaacgcttcttttctagtaaagcaatcaaactattgcttaacatggacggtactcctttcaatatttaacaaaaatagcattcgtaaacaaatatctctgttgagtttagataataatctaactcattatatagcgctttcatgaaaatgtatatataataaaagttagttaaaatactgggatgatctaaagacaaaagagaggaaggtaaccaatgaatcttaacaagcccaagattgctgaacaaagtccaaagaaaatctttcttttcgatatgacattcagtttgatttcttctgatggacttttgcaaacgcaacgtttagaaagaaaattgacacatttctttcaaaaagagcaaaaaaatgtgtcagtcaaagtatatgattctagccaaatagacaaagaagcaaagagagcagacatcttattgctcactcctttacttggatatgcaaaagataaaatagaaagtcagttccctgaaatacctattttcgtaatatctaaggaagaatacggaactttggatgtggagaaaatagtagagaagctagggactctttataaataaaaatgggcgatcattcagaatgttattcgtttaaaattgtgctgctaggagttggaaatttatgtttgattcagaaaaagtgaaagaattaaatgaattggagttgattgtttatacatttattttagaaaatatgaatcaaatagttgagtggaccattcgcgaattttcaaatcattgtcatgtatcaacatctacgatattacgttgtttaagtaaattaggtttttcaggctattcagaattcaagttttctctaaaagaaaaactaacgaaaagtcgtcaaacatttgagtcattttatgaagcaaatgtgcatgtcgatgcttttttgaaaaaagtgaataatgaaagttatcacgttgttttagatcctgcaattgaactcatttcattacatgatcatttgatttttactggaattgggactagcggaacattgggaacttatggtgcacgttatttttctaatttacagtttaatgcctactcgattactgatccatttattcctgtaccgacacgtggattagagaaaacattagtgattgtattatccgtttctggagagacaggggaagttattaaacaaatcgaaaacttcaagcgatacggtgcaaagatcttaagtatcacgaatgatcagcattcaacgattgctcaactatcagactgcaatatctcttattacatgccggatgtctctggaccagacccgacagataatgcgattaacttaactacccaagtaccagtaatcgcgcttttggaaattttagcgcatcaagcttatcagaaagaaaatgcgataaatctgaaataaggattttttggaatctattataagaaatcgtgcagtttatacatatcaaactgcacgatttcttatcgtttcagtaaagttgtttttttccttggtacatgtttttatacgttctgaaagtattccttagaaggttcaaatcgcttaaaatgtatttgtaaacggatacaaaaagtggctggccagcgcttcaaaaaatgtgaaggaggatcatttatgaataactttattaatgaaaaattattgccgcctatattaaaatttgtaaacacgaaagcaatcactgcacttcgtaacgggatgctttacacgatgccttttacaatcgtaggttctgtttttttgcttttagcgaattttccgataccaaccatttctgaatgggtcgctggtagcggcttggctgtctatttcaacgaagcattcggtgcttcatttgctatcatgtcgatttttgctgtaatgggtattgctaattcctatgtaaaagaagaagggttcgaaggcttgcccgctgggatgattgcattagtagtatttttattaactcagcattcaagtgcaacgaatgctgagacaaaagccattgtaactaacgttatcgacaaaacttggactggtggtcaaggaatgatcagtgcaattctagttggattatttgtagggtggacttattcttggttcttgaaacgagatatccgtatcaaattaccagaacaagttcccaccaatgtagctaactcctttacagctttgattccagcggctgtaatcaccgttgtatctcttatcatttatgctatttttgataaagttttcaacacgactgttgtagaagctatttatacagtaatccaagcaccgatgcaaggagtaacagatacttttggaggtgcgatgatgttaggcttcttggtacctttcttatggttctttggtgtacacggctctactttagttggagggatcatgggaccgattttgcaagcaaattctctacaaaatacaacgattttgaattctggaaaagagttgacagtagctaatgggggtcatattgtaacacaacaatttttagaccaattcatgactataacaggtgctggtatgacgatcggcatggtgatgttcatggttacatttgctcgctcggctcaattcaaacaattaggacggctagctttattgcctgcatttttcaacatcaatgaacctattttatttgctacacctgttgtaatgaaccccttgatggctttgccctttatcttggcaccaatgatttctggtatgatcacctatttttcgttatacactggacttgttcctttatttacggcagtacaagtaccatggacaaccccgccaatcatttctggatttttagttggagggtggagagctgctgttctgcaagcagtggtgttaatcattggtttcttcatttatctgccatttgtacgtaaagttgatgcgttgaattatttacaagaacaaggtgaaagtatggaccaaatcgaaaaagacttagcagacgaaacaaaaggacatgtagttcttcaaacagaagatgaagaggtaggaatatgagtatattgaaaaaagagtttttatggggaggagcagtggctgcccatcagattgaaggtggctggcaagctgacggaaagggaatgagcgtagcagatgtgatgactgcaggatctaatcatgtacctcggagaatgacagatggtatcgtagaagaagaaaattatccaaatcatcaagccattgatttttatgtacgatataaagaagatataaaattatttgctgagctaggtttgaaatgtttccgtacatcgattgcatggacgcgtatttttccaaatggagatgaattggaaccaaatgaagcaggattgaagttttatgatcaattatttgatgaatgtttaaagtatggaatcgaacctgtgatcacattatcgcattttgaaatgccttatcatttagtcaagcaatatggtggttggcgcaatcgcaagatgattgatttttttgtgcggtttgctgaagtttgtttttctcgttataaagataaagtaaaatattggatgactttcaatgaaatcaataatcaaacgaattatcaagaagatattgctccctttactaattctggattgaaattcactgaaggagaagagcgagaaaaaattatgtatcaggcagctcattatgaactagtggcaagtgcaaaagctgtcgaaatcggacacgcgattaatccttcttttgagattggctgtatgattgcgatggtaccaatctatccttattcttgccgtccctcagatatcttggcagcaacagtagctatgcaacgtcgttattggtttacggatgttcattgcaaaggggcttatccaagctatataaaatcgtatttggaccgtaaacactttgatttggatattacgtcagaggacgaagcgcagttagaaaaaggaacagttgattatatcggttttagttattatatgtctttcgcagtcaaagatcatgaaaaaggtccatcatatgattatgatgaagcacatgatctcgtaaacaatccgtatgttgaatcctctgaatggggctggcaaatcgatccagatgggttacgttatgccatgaattggttcaatgatcgatatgaactgccactgttcattgtagaaaatggctacggtgctgtcgatgtcccttctaaagacggaaagatccatgacgaataccggattgcctatttacgtcagcatatagaggccatgaaagaagcaattgtttatgatggtatcgaattgatgggatatacaccttggggattcattgatctagtgtcagctggaaccggggaaatgaaaaaacgctatgggttcatctatgtggataaagatgataacggcaatggcacattgaaccggagcaaaaaagactctttctactggtttcaaaaagtgattgcgagcaacggagaaaatttatttttttagcagtgagataagctagtcttgtaaaaaaacaagagaacacgctacgttcatttattaatttgaacgtagtgtgttttttattagaagttataactgtaaaaaatggtgttttaaccagtttttcgataatcttaactacctaaacaaacatatttacatcctaattcttaaaatgaatctacttggatgatttttgtccccatattcttgattttgtctaatactttttcagagcaaaatttatcagtgatcaaataatcaaagactgaaatatcagcaatcttgaactttgatgtcagtccgatttttcgatgatcagcaactagaatcttgcatttgattgtctggttgatcatcatttcattgattgttgattcattcaatattttcgttgtgaccccatgtgcgacatcgactccgctgcaaccaatgatacaaatgtctgcattgattgaagaaatcgtatttaatgcgatatcgcccaccagtgcttcttttggaaagcgcatctctccgccagttaaaatataactgcaattatctttgtgaggagaatagttgatttttacgttgtttgtaacgacggtcaaatggttagattgaagaaaatccagtgttttcaatgcagtcgaactagaattaataaacaatgtatcataatcgctaatgtatttactagcttctctggcaatcgcttgtttaatcctttcaggaccagattgatcaaaatcagtctggtttttgtaattataagaacaataaccgtaattgcggatgatctcgtttttttcttctaataaatttaaatctctgcgtatcgtactaatagatacatccagagattcagctaattcaaaagttgacaattgttaggtttgctgaagtagttccaaaatatctttttgccgtttttcaatattgacaagtgagtttttcatgactgttgcctcctgaaggtcatcttgatccatggatttatttgattagttgttcatttaaatattcatatctgtctttattatactgaaacgatcattaatctttaaaagaaaatcatataaaagacaaacagtcatataaaagggttttcatgcatgcggctacgcattaagatttacttgtaagtcgtaagaatgatatggggggagcaagcaaatgagcaaaacggtgaatgaagtgacaaaagaaaagtggatattagaaacatttccagaatggggtacgtatttgaacgaggaaatcgaatcagaggtagtggaacctggaacttttgctatgtggtggctaggctgtacgggcatttggctgaaaagtcatgaaggaacgaatatcttatgtgatctatggtgtggaacgggaaaacgcagtcatggaaatggcatgatgaaaaaagggcatcagatgatgcgtatgagcggtgttcaaaagatgcagcctaacttacggactcagcctttcgtaatcgatccttttgaaataaaaaatgtagacgctttaatcgtcacacacatccattccgatcatctagatatccacacagctgcagccgttcatcaaaattgtcctgaagcaatattcattggaccaaaagaagtggttcgcacgtggcaaaaatgggggatccctgaagaaaaaacgattatcgtgaaaccaggtgatgcggtcaaaatcaaagatatcaatgtagtagctttagaagcgtttgatcggacagcgttggttacttgtggagatccggaagaagtattgaaaggaaaaatgcctcaggagatggatcaaatagcagtaaattatttattcgaaacatcaggaggtactctttatcacgcaggagattcacattattccaatttatttgccaaacatggcaatgaccacaaaatcgatgtctgcttaggagcctacggtgaaaacccacgagggataacagacaaagttacttctgttgatatgctgcgcatggcggagtcattgaatgcaaaagtagtgattcctgtccactacgatatttggtctaattttatggctgatcctaaagagattactgaaatttggaaattcaagaaggatcgcttacagtatgggtttaaaccttatatctggcaagtaggcgggaaattcatctatccgacaaacaaagatgatcttgagtttaatttttatcgcggatttgaagatgtcttctcgattgaaaatgatacaccgtttccgtcgtttttataagaaagaagggaagtttcttgctgaaatacttttttgaccatcaattgatccattacccagataaagaaatcacggattggcgtgaagctatcgccgaaagctgtcgtgtattgattgataagaacatcattgatcaaacgtatgttgaagaaatcattcattgtgtagaaaaatatggaccttatattgtgattgcacctcaagtagccatgccgcattcttcagaaaaaagtgagggagtttttggaacggctatttcatttaccaagttgaagcagccagtccgttttgaaagtgaaggggagaatgaggagaaaacggccagtttgttttttacactcgcagcaaaaaatccagaagaacacccagaaaatatccaaaaattatccgaattattaatgacagatggattggttgagcgtctcatctctacgaactccatcgatgattaccaagttgtgatggcggaatataattaattgatagaggagaaaaaagatgggggaatttttgttaagcatttggacgtattttgcaacaaatatcttgacgcagccagcgtacctgattggttttatcgtgttattaggctatattttgctgaaacgcccacttcatgaatgcatcgctggattcttaaaggcaacggttggctactttattttgactgttggctctggtggtttggtcaaaaattttcggccaatcttggttggactgaaagaacggtttaatctggatgctatggttacagatccttattttggacaaaatgctgtggatgctggattaatggagacatttggccgtacctttggagatgtgatgattctattactgattgcatttgttttaaatattttgttagttcgttttcagaaatatacgaaactgcgattcgttttcacgaccggaaatgttcaggtccagcaagcagcgaccgctttttggattttactgttttgctttcctgatctaggcaggatacaagtattgatatttatgggattgattttagggtgttattgggcagtagcttctaacttaacagtagggatcacgcaggaattgacagaaggtgccggatttgcggtggcacatcagcaaatgttcggaatctttatttttgctaagctagctgaatggatgaaaaagcgggatgaaaagaaaaatcgattgatcaagcaagacaagaaaatcgaagatatcaaattaccaggattcctatcgatatttaatgagaatatggttgctacttcgttgctcatgctatttttctttgggatcattctgattgtactaggcaaagattatttgattcaagcgcaattcatgcaagaggggcagagtttcttattctacattatgacgacttccttgaattttgcggtatatctggcaatcttgcaattaggtgttcggactttcgtcgatgaactaactcaatcttttcaaggaatctcaaacacgattttaccaggagctgttccaggaattgatgtagccgctacttttggctttggttcgccaaatgcggtaacgattggatttttgtttggtgctttgggccagtttttgatgattggtttactgattttattgaaatcaccaacgatcgtcatagccggtttcattccattgttctttgataatgctgttatagcagtttatgccaataaccgaggtggattcaaagctgcctgtctattcccgtttctttctggaatcatacaagtaggcggttcagcattattcgctacatggatcgggatgtcaacatacggtggttatattgggatgttcgattgggcgacagcttggccattatttacagtagtcatgaaagtcctaggttatgctggaatcgtcgtagtcgtcattggtctattggctattccgcagttacaatatcggaaaaatcctgaagggtatttcttgattgtagaagattatgaaaaatatgcagaaaagcagaaagcataaaagaaatctgattagacaacactcataatggagggattaggatgagaattttagtatcgtgtgcaaatggatcaggaaccagcttgatgatgatgagaagtgtagaaaaagcaatgaaagaactaaatataccaattaccaagattcatcattgtgctatttcagagggaaaaagctcagccagtcaatatgatgtcgtttttacaccagtcaattttttgaatatgtttactcaggcagagaaaaaaggcgttacagttatcggtatcaaaaatgtgatgtccgccaaagaaatcagtgaaaaatttgctgaaacaacatggtatcaaaaaaacaagtgaaagaaggaaccaagatgagcaggccgaatctacaaattgcgttagatcacaatgacttagaacatgcattaggcgatgttatgaaagtcggtgatgtagtagatattattgaagtgggaacgatcctttgcttacaggaaggacaaaaagcgattcgctgtattcacagtatatttccagacaaaaaactggtcgctgatacgaaatgtgcagatgctggaggaacagtagcaagaaatgtggctaatgcaggagcagattggatgacagtcatttgctgtgcaacaatgccaacgatgaaggcagcacaaaaagagataggcgaattacaagtagaactctatggcaattggacttttgagcaagccaaggattggtataacatcggaatccgacaggtaatctaccaccaaagccgtgatgcactcttatctggtgaagcttggggtgaaaaagatttgtcgaaggtcagcaaactgattgaactaggcttcaatgtttctgtaactggtggattaaatccaaacacattacaattgtttgaaggaatcgatgtgtatacctttatcgcgggtcgggggattacagcagcagaagatccaatgaaggctgcacacaatgtttcaaagatgagatcattcgtatctgggggtaaggaaatggctcaaatcgggatttatgaaaaagcattacccaaagatatttcatggaaagaacgtttttcccttgtaaaagaaatggacttcgattttatcgagatgtcgattgatgagacggatgagcggttagcacgattagattggtctgaagaaaagatagctgagctgagagaagagatgtttagctctggtgtacgtatccattcgatttgtttaagtgcgcatcggcgatttccgtttggttctgctgatccagaaaagaaaaaagcagcgaaacaactaatgaaaaaagcaatccatttggcgcataatctaagcgtcaaagtaatccaaatagctggatacgatgtttattatgaagagaaatcaatgaattccagagaagactttatcgaaggaataaaagaaagcgtaaaggaagcttctaaatatggcatcattctttccgtggaaatcatggatgatccatttatgaactccatttcaaaatttttagaaatcaaagaacagattcattccccttttctacaagtatatccagacctaggcaatttgtccgcatggccggaaaataatccggctcgagaacttgagaaagggatcgattatatcactgctatccacttaaaagacacgtatcctgtaacaaaagaatattcaggtcagtttcgtgatgttacttttggtaacggatgcgttgactttcttggattattgagacatttgaaacgtttagattatgatggaacattcctgatcgaaatgtggagtgaaaaaagtcaagactttcgaagagaaatccagcaggcaaaagactacttaagttctaaattgaaggaggctggttatgatgtcttgtgaagaaaaaattgcagcaatgaagcaacgtgtctttgaagcaaatctggcattgccgcaatacggattagttaaattgacttggggcaatgtgagtgaagtggaccgtgagctaggagtcatcgttattaagccaagcggtgtccgatatgaacgcatgcaagcagatcaaatggttgtaacagatttgtcaggaaatataatagaagaagacagcttgaaaccatcttcagatctgcctacccatgttgttttatacaaagcttttgaagatgtaactgctgttactcatactcattctactcactctgtcatgtgggcgcaagcaggccgagatttgccagcttatggcacgacccatgctgatgctttttatggaaagattccttgtacacgccaattgacgaaagaagaagtaaaagaagcttacgaagttcatacagggaatgtgattgtcaagacgtttaaggaaagaaatttagagccaaacgaagtacctggagtacttgtctatggacatggaccattcacttggggacactcacctatagaagcagtagaaaatagcctgattttagatgaaatttgtttgatggctaaagaaaacgagttgatcaaccaaaatataggtgaaatcccacaatatttgctagataaacattattttcgaaaacacggaaagcatgcatactatgggcaatagagatgctagggtaagggtagaaaattaaaagataatacttgatagagagaaacagaggttgtgaagaaaatttatcacaacctttttcctacgattagtcaagtaaaaggtgtaagaaaaatagctcataaacgaaagcgacaaaatcaaggcacaccaaataaagccccgttcgtaaaaaattttcgatctgggcatttcttctagtctacacaccttaatttttctgtctagttaattgtagcctatccattgttttagacttcctttcgtgctaaaatacagttaagttattttgttatgttgccgattagcgattgccgtcgctggtcggtcttttttgtgttggcattttgaaactttctcttacagcagtaaccgctactaaggttccccaataaataagtgcatatgctggattaatacttgccagtacgattgctactaggctcataagcaaagcgcttttgacagtcattttaaataccgttctcattacttcactctcctctctaattagtattgcgttcttcccattctttaactaattcaaaatcgtattgcaaaacacctctaactcttcgggaaggtaatggatcattatttgaattagtccatttggaaatagtagctactgagacaccgaaatattcagcaatatctttagctttcttccatactctttcttttggcttcttttttggagctaaaggaaccactttttccatttgtgaaactttcattttaactctcctttcatgtatccttgattaatccaatatgataatcgctcttcacttagtttccgaatatcgatacctaatatttcacacaaagtactaattagagttacctccaccatgatttcatctaagtactcataagcgtatgaaattatttgttgacgatcatcaacggttaaatactcaacgtttttgagaagaattttttcgacatattgtttcttctgctttcgctcatcggattcaattatttgaagcttatctagtgaagaaggatctcttctataaacatcactatcaatagatttgaatagtccaaaaaattcatggatcacttgcatagtaaaattagaatctctgaaatgatctgttaacacttgagcattttctaacgtcacaggcttagtcttatgtggcgttgtccagtcactcaatgactgttgagatacattaacttgctttgctatttctttcttcgttttgccactcttatttatcactttaattaatgattctcgaatgacagctgattgttttaacagtttaaacacctcaatttcttattcgcccgtatatcaatacgagcaattttttttatactattaatttaaagaatcaaacgaaagctacttcgtctaattcacgttcaagctctttttgaacttcttcaactaaacgattaagttgatcatctgtagcacacttaatgatgtgaactagtctaggtcttgcatcaagtacgatgtttattttttcttgtcgtgtcatttggtgtttctcctttctttatcactagtttcgattttagatactttatgggtaaaaatttttgctaatgggatatccaatagctttgctaaataaggcagttcttctggtttaaaattatattcgccagtttctcttctataatattttgccttatcattaaaacccataagatcagacattttttttaaagagtaaccttttgttttgcgtcgctcttttattagttcaagatttacttgatacatattagcacctccaaagtttcttttttagcaaccttatatacatataacacattgcgattttagatacgtcaacagaaaaagtatcttttttcgcatctttttatatcttttttcgcaactatggtaaaatagttgtgaaaaaagcaacgaaaggagtagtctaatgtcaaaagatctagtgaatagaataatagatttacgagaaaaacgtgactggaaccaagcagagttgggcagaaaaattggattagaaaaatcagcaatgaataaaattgaaaatggcactagaaaagtttctacagaagaactccagaaattagcagaagtttttaatgttactactgattacttactcggaagaaatcaaactcctgaatgggctgatgaaaatgatttagttgaattagataaaatgctcgattccaatgttaatatggcttatggtggcgaaacgttaactgatgaagagaaacaaagagtaaaagatgttttaactggtctattttgggaatttagaaaagaagacaaaagtaaagagaagtgattttctatggagatggacgtaattagtctagttggcaaactgaaacaaaaatataattcggccaatccctttacaatttgcgaaaaaatggatattcaaattaggtatgttccttttttgaataacccaaagggacaatttcaagaattgttaggacgttcgattattcttctaaatcacgaactaaagtattctgaggaacggttctatatttgcgctcacgaactaggtcacgcagtttttcatcaaggtttatctagttattatgtctctacccgatcctccagaagtaaatcagagagtgaggcaaactgctttgccgccaatcttattgtttctctttataaagaagataatgatcaatatcctagaaaaattgaagatttaacaaatttatatggacttcctaaaaattcgtatagatttttaatttaattggcgactatcactacctgccgttaagtgggagtaaatatatttttatttgttggaggaagaaatgaaaaaaatagttggggtaggattaattctgttctctagtatcgtactaggagcatgtggaaatagtaattcaaattctgatacgcctaaagaaacaaccactgcgagctctacaatggtttctcttgaattcagtagctctgtggaaaaaaagactaatcttctatcaaatgattcagatttcggaaaaatagctgataatgtacctgatggagaatccatagaagtacaaggtaaacaagattattcaaccaattttaatgataattcttgggcgggtgttaacctaaatatcgatcgggtctcagttgtgaaaactactgatatcaaagactattcagataatcaatacaatggttttgtagccgtgcattacaacatagataatacacaacaagatgtatctatataccctaatcaagccacaattgtaactgactatggtgagcaagttgatgatggcggagtctttaattatgattcatgggatggtgacttcatgaaaggaacaaaaaaagatggttggggcatctatcctttatcaaaacttcctgatgcatcttcaatcaaatctcttcgattgaagattgattctagctatgaaactgataattatgatgatgaaaactcgtatcacacatatgatattaacttaaatttacaataaagactggccttcgggcttttctttttaaacgtaaaagaacataagttcgtataaaaactctgctaatacgacgattttctaaatattcgttcaaataacatacctcccctaaaatattcttattattaggaatgaaatacgaaaggattggttttaatggcttccattaaaaagtactatttaaaaaaatcaaaagaatatcgttatgaagtctatatatcaaatggaattgatcctggtactaagctacagaaaaagattcataaaaaagggtttaaaagtcatgaagaagcagaaagattcgcaaaaattgtcgaaggcgaaatagcttcggaagaatatacacaaaaaaaccctaaaaatttgactatagaaaagtttatggacgattggattaataactataaaatgaatgttaaagaaggaacaagaattgttcacagagcaaatataaaaatgtacatcaatccatatattggaaaatataaactagataaatatactagagctgatcatcaaagattcatcaatcagttacttactaaaaagggtttggggagaactaaggaaggtctctcagtaacaacagccaaaagtattaacgccactcttagcaatgctttcaaaaaagctattcagttaggatatataaagaataaccctactagttttgttgagtttccaagaaatccatctgataaaaagaaagttaaatattatacttttgatcaatctgaactatttctcgaatttgccaaaaaagaaaaatcatttatatggtatcccttttttcttattatatttgatcaaggattgcgaaaatcagaagctttagggcttcaatgggctgatattgatttttctcagaatacacttaatattaatcgtgaacgtcttgggctgctgaaaaaggacctaacaaaggtttgattattacagatgacacaaaaaccccatctggtacacgatcattgcctatgacaaaacgagtaaagaaagccttattgactttaagaaatcaagtaataaaagaatttggttttttacctgaaacagatgaccacgaagcatttatttttataaacacttacggaaaaaataaaggtattccaataagggatcgaactgttaatggtgcttctcacagaattgaaaaacgtgctaatctcccccacataactgtgcatgatggcagacatacttttgcagctagaacgagacaagcaggaatacctttagaagatatcaaagattttttaggtcataaagatgtttctactacacaagtctatgcccatatttctcccgaagtgaaaaaaagatcaatgaatcaactagaaaactatatagaagagcaaataaaaaagcactcaaattgagtgcttttttaagttcactatcactaaaactatcactaattttatttagaagcgaacatgtttctatcactgattttttaaatctagcgaaaaccccttattttaaaggcgttcgttcaattctttagcaaggtcttcaaagcctggtttgcctagaagtgcgaacatgtttttcttgtaagcttctacacctggttggtcgaatgggttgattccattcaagtaacctgaaatacctacagcaatttcaaagaagtacattgtgtaacccaatgtgtaagcatccatttctggaattttgactagcaagttaggtacgtcaccgtctgtatgagcaagcaatgttccttcaaatgcttttgtatttacgaagtccacttcttttccttgcaagtagcctagaccgtctaagtcttctacttgttcaggaatcgtgattgatttacgaggtttttcaactttcacaactgtttcaaaaatattgcggcgtccttcttggatgaattgtcctaaagagtgcaaatcagttgagaagtttgcgcttgaagggtagatgcctttttggtcttttccttcagattcgccatacaattgtttccaccattctgagaagtattgcattcctggttcataattgatcaacaactcagttactttgcctttacggtaaagaatgttgcgcattgctgcgtattggtaagcttcgttttcttctagtttgtcgcttgaataagctttgcttgcatcagcagctccttgcatcaatgcgtcaatatctgctccactaacagcgattggtaacaaaccaacagccgttaatacagagaaacgtccgccgatgtcatcaggaatcacgaaagtttcccaaccttctgcatctgcttctactttaactgcaccttttgctttatctgttgtagcgtagatacgtttgtttgcttcttcttgtccgtatttcttaacaagaagctctttgaatacacggaaagcaatcgctggttcagtagttgttccagattttgaaataacgtttactgaaaagtcgcgatcaccgattacttcgatcaaatcagcgatatatgttgaactgattgaatttccggcaaagaagatttgtggtgctttgcgtgtgtcgctatctaatagattgaagaatgtgtgattcaagaagtcgatcgctgcacgagcgcctaaataagaaccaccgataccgataacaactaatacttcagaatcagattggatttttttagctgcttctttgatacgtgcaaattcttctttgtcatagttcgttggtaaatcgatccagccgcggaagtcgcttcctgcaccagttccttcccgtaattcgttgtgggctgctgttacttggctttgcatgtaccctaactcatgttcattgacaaacggtgctacttttgaatagtcaaaatgaatgtgtgccatttgttctcctccttataggtttactctacaggtaatactttacgtttttttttattatttttcaagcaaataaacaaaatgctgacaatatttccaagaaagtttcattttttaaactaaaccttctgctgccattgctttggcaactttttcaaatccagcaacatttgctccaagaagcaagttcttttcatcgccatactcagcggctgtttggcgacacgtatggtaaatcttttccatgatttgatccagctgctcatccacttgttctctttcccaagtcaatcgctgggcgttctgactcatttctaaagcagatactgccacacctccagcattagcagcttttcctggacaataccacacgtctgcttcatgaagaacagaaacagcttttactgtacatggcatattagcgccttctgctacgattttgatcccattttctactaagatttcagccaagctttcgtctatttcgttttgagtagcacatggcaaagcgatatccgccttttctttcaatgtccaaacagattctccagcatgataaacagcagaaggacgttggttcgcgtattccgtcaaacgttgtctattgatttctttgacttctttcaatagtttcacatctattccttctggatcatagatgtacccgttggaatctgaacatgtaaccactttcccgcctagctcttgcactttttcgattgcataaatggctacattcccacttccggaaacaaaaactattttttgattaaatgaatctttttcttcgttcaatagatgtttgacataatacactaatccatatccagtcgcttctgtacgtatcttgcttccccagaaatctagaggtttacctgtcaacacaccagtatcatattttttcaatcgtttatattcgccgaacaaatagccgatttctctagctcctacaccgatatctcccgcaggaacatcaatcgatggcccgatatgttttgacaattccaacatgaaactttgacaaaaacgcatgatttcattatcagatttccctttaggatcgaaatcactcccaccttttcctccaccgattggcagaccagttaaactattcttaaaaatctgttcaaaagccaaaaattttaagatacttaggttgacactgggatggaagcgtaatccacctttataagggccgatagctgaattgtattggatacgatagcctctatttactcgccagtttcctttatcatcttgccaaggtactcgaaattgaataattctttctggttctgttaaaagttctaaaatattcttttcgatatattcgggatgagtgtccaaaaaagacattactgtgggcataaattcatcgattgcttgtaaaaattcttcttgtccttgatccttttgatgtagcttttcttgaattgcttgaacatattctgttgcgtttgtcatcgttccacgctcctttgcttatcttccctcattttagctcattttctcttttggctcaaaacatttttttctgttttctttcttcaaatatgctacactttccttgaggtgagggaatggaaaaactgtatgatgtgatcgtagtcggcgctggaacaagcgggatgatggcagcgatcagtgcagctgaacaaggcgcacgcgtacttttgattgaaaaaaacaaaaaagcagggaaaaaactactgatgacaggtggtggtcggtgcaacgtcacgaataatcgtcctgttgatgatttaatcgcacatattcctggaaatggaaagtttttatatagtacatttgcgcaatggaataatttcgatatcatgaacttctttgaatcacaaggcgtacatttaaaagaagaggatcatggacggatgtttcctgtgacaaataaatcaaaaacgattatcgaagcattacttaatcgtctgaaagaactagatgtgacgatcctattctctactcgagtagagaaattgatccacaaagaacataaaatttacggtatacgcacggaattcgaagagttccatgctcctgccgttatcttaacgactggtggtcggacttatccctctactggttctactggagatgggtacaagatcgtgaagcgagtaggtcacacggtgacgcctctttatgcgacagagtcccccttgatatcggatgaaccgtatattcaagagaaaacacttcaagggctttctttacaggacatcactttacgtgttctaaataaaaaaggccgtgtattgactgaacatacgatggatttgcttttcacccatttcggtatttctggtccggctgcactgcgttgttcaagttttgtcaataaagaattagagaaaatgggagaaccagtgatgctttctctggattgtttccccacacaaaccaaacaagagcttattcatttattgacagaaaaaagtaaagccaccaaaaagaacttagtaaatgcttggcacggtctattacctgagcgattgttggttttctttcttgagcggcttgaaatggacagcctaacaggacaacaagcctctcaaaaacaaattcaagatttcgttcaattatgcaaagagtttaagctatcaatcaacaagacttttcctattgagaaatcatttgtaactggcggaggggtttctctaaaggaaattcatcctaaaacgttggagagtaaaatcattgatggtctgtattttgccggagaattactggatgtcaatggttatactggcggctttaatatcacagcggctttcgctacaggacatgtagcaggaatgaatgctgggcaaagagcataatgtataaaaaagaaagaaggagactgggcaaacaacatcccggcctccttctttcttttatacgtatgatttattgttttatatctgcaaattgtccgctcgttaatgcacagatatcttgaggagctaattccatctgcagccctcttctgccagctgatacaatgatttgatcatagttttctgcgatttgatctaaataagtaggaaatagttttttcattcctataggcgagcagccaccacgtatgtatccggtcgttgcttccaaatctttcaaatgaagcatttctacttttttattccctgaaacttttgctaatttttttagattcaattcggcttctcctggtatcacagcaacaagaggccccgtcacattgcccacagcaaccagtgttttaaatatacgagattggctctctgggagctgttcggcgacagaggacgcacttaggtggttttcgtcccattcatattcgtgttctgtatagggaatctttttttgttcgaccatacggatcgcattcgtttttactatttttttctttgccaaaaaatatcacctcaaacttgttctacaacggttcatttaataattggataatttgcttcaatgctttgaccggtaattgtcctggagcagaaacagaatcactgcttaaggaaccaaacgtcatgacggatcctgtcgttccgccagccagacgagaaattttccccagatcgcccatagacatcgtaatgataggcatggagacaaaagcatttgcccgtctagtcaactccatcaaccgcaaaacatctcgttcattgttgggagtcactgccaactttccgatatcagcgccaaaatgttccatgacattcaaccggtaaagcaagacagggtcagctggtgtttctttaaaatcatgactactgatgatcaaagggatatctaaagatttgatttcctctatcagtcctttccctaaactttcaactttgaacaactcgatatcgaccatatctactaatccagtgtgtatcacatgttcataaagatcgcgatactgacggatcgatatgtcttgttctccgccttcagctaaggtacggaacgtaaataataacggcaatccatcaagcatctcatggataagaaccaatgtttctgcaacttcatcaaaagaaaaaaccttacgataatgatcgactcgccattcgactaagtcggcccctgcttcacgtgcaagaactgcttcacgtaatacttcctctcggacggctccgataagaggcgcacaaatctttggtctaccgcttcctatattcaatccctttatccgaaccactctgcatcgctccttctaatggttatttttaatttgataaacaaacactttcagataattgccttctaaaaaggtatccgtcgtctggaaatcttttggcagacgatataaagcaatttgttcaaaagaaacattcttggcatggaattcctcttcgatcattgtttggaattgttcgatcgagacattcgcagcatttgtagacgcaataagtatcccatcttctgctaaaatatccagactatccttgatcagttccccataatcttttgctacgcgaaagacttttttcttgtttctggcaaaacttggtggatccaatacaatcatgtcatataaaaattgttttctttttgcgtatttgaaatactcgaatacgtccataacaatgattttttgctgatcgacatccaggccattcacttcaaactgttcttgtgtttttttcaaactgcgttttgctaaatcgacacttgtcgtttcgattgcccctcccattgcggcagcaacagaaaaggcgccggtataactaaacatattcaaaactgttttcccagaagcgaaaccttctgctaatgatccccgtacttctttttggtctagaaagataccagtcatcaatccttcattcaaataaacggcaaattttactccgttttcttttacgaccaagggctccggtgcctcttttccgtaaatgaactggctctcaggcagattcactgattcaaaacgaattttctcatatccgccaatgatttccggatagatttcacgaaaagcttgaatcaataattcacgatgtgtatataacgtctcgttataccaagaaaaaacagcataacctgcataataatcaataatcagaccgccaattccgtctccttctccattgaatatacgaaaagcggtagtagaatcatctgaaaaaaagaaagttcttttttcttttgacttcacaaaaagttcttcaaaaaatgattgatcaaatgggatatcctgctggctcaatacccaaccgatccctttattctgctttcctagatatccttttgcgataaattggttttgcggatcaactaattccacccattgcgtggtttctttttggggatgtgcaaggtcttctttttggatcagtgggtatcctttttttaatcgactgcttgctcttttttttacttgtactttcattccttcacctgctttagctttctcttctcaagtataacaaaaaacataggacttgtcttactgctcctttttcatcaagcttaaagaaaaacttaatgaaacagcacaaagttctggtttcaattgacactatattgtcatactagtaaaataaatgagaataagtgagctgtgtaacatggtttcatgacacttctgtgattaagaagtgcagaaaggaagattatcttgaaatatataaaaacacctgcctttttgaataagaggctcggatttttttctttactagtcgttttactttggttgaaaacgatttttgcctatttggtcgatttccatcttggaattgaaagtggcattcaatactttatcttgtttatcaaccctattgcaactacactgttattacttggaattgctctttatatcagacgccccagagttgcttatatcacgatgatggtcatttattttcttttgacattgcttgttttttcgaatgtcacttattatcgagaattcacggacttcattacgatcaacacgattttaggtgctgggaaagtagcaagtggtctgggagaaagtgccattcgactgtttcgcccatatgacgtgatctattggatcgatttcattatcttgactgttctactgatcgccaaaaaaatcaagttggaccctcgtccgattcgagcaagaatggcttttgcgatttctacattagccgttatgattttctcaggaaatctttttatggcggaagctgatcgtccagaattattgactcgtacattctctcgggattatttggttaaatatcttggcttgaatgctttcatggtttacgacggcgttcaaacttaccagacaaaccaagtgcgggcagaagcaagtcccaatgatatgaaagaagtagaaaattatgtaaaagaacattacgcagcaccaaatgatgatttgtttggacttgctaaaggaaaaaatgtgatttatatccatttagaaagcttccaacaattcttgatcgattataaattgacagatgagaatggtgtccaacatgaagttacacctttcatcaatagtctttatcacagcaacagcacgttcagttttgacaactttttccatcaagtaaaagcaggaaaaacaagtgatgcggaaacgctgatggaaaattcattgtttggcttgaatcaaggctccttgttcacacaattaggcggaaaaaatactttccaagctgcacctgatattttaagtcaaacagaaggctacacgagtgccgtgtttcatgggaacgccggcacattctggaatcgaaacgagacctataagaatttaggatatgattatttcttcgattcttcttattatgacgttaatgatgacaattcgttccaatacggtttgcatgataaaccatttttccaacaatctgtagaatacttggaacgtctgcaacaaccattttattcaaaattcattgctgtatctaaccattatccttattcgaaattcaccaatgacgaagctggattcccgttagccaatacaaacgatgagacgattaacggttacttcgcgacagccaattatttagacactgccgtacaagaattcttcaactatttgaaagaaagcggcttgtatgataattcagttatcgttctttacggtgaccattatggtgtttcgaattctagaaataaaaatctagctgaattagttggaaaaacaagttctacttggacaaattatgacaatgcacaaatgcagcgtgtcccttatatgatccatattcctggacaaacacaaggcgggatcaatcacacttatggcggccaagttgatgctttgcctacactgctccatttactaggtgtagatacaaaaaattatattcagttaggacaagatctattctcgaaagatcatgaacagcttgtttctttccgtgatggcgattttgttactccaaaatatacttactacggtggtaccatctacagtaacgaaactggtgaagccattactgaacctactgaggaagtacagaatgaaattgattcactcaaagaaaaagttgataaacagttagctgtttctgatcaaatcaataacggtgatcttcttcgtttctatacgaatagtggattagatccaattgataccagtgattatgactacaagaatggcttagagaaattaaaagaagctgaaaaatctctaggtgacaaatcaactagtgtctttagtcaacacaacagacaatcaactgttgatctttataaaacacaaacgtatcaagaacttcacggaacgaccacaggttcttccgaatgataaaacaaatctgaaaggagctgcgacaaacatcttgtcgcagctcttttttcacaacctcttgcaaaaagcaagaggtttcctggttttggttttaattcgtgattttactaaaggaatttcatactttattcatattcattttttatactttttatagaggtgaaaagtatgaaaatgatccgctatgctactgctcgattaatttattacaaaaagcagacaatactctattgtttattttcaagcttttctgcttttttattgatagcatgcctgactctctaccatttgcaatcggctttagcgaatcaagtccaagatcggctttcatttattggtgcttctgcatctacggagcttcttccggctttagaattagctagccgattttatctaaaaggcatattcagtttattttttctatttgccttcttttttatctttttcttttactattcactcaggcaaaaccagcaagaattgatgaattggcgcctgactggtctttctaaagccaaactgttcctttttattttttggcagctgttctttcctctctttctttgttgtatcttggttttattgtggatcgtcagcttccagtcggtttatgaaacactgcttcaaaggatcaattttcttgtcttaaagactgctgagctgccagatatccgtgatatcttgacttcagtaagcggacttacgattccgatggatcagcagactttctttactatcgattttcaaaatgatctgtttttcacagatattcttagaggctttgcccaaacacttgttggacttagcgggtgctgtctgattctcagcctattgccattcactttttttatccatcacttgcaaagcaggaggtctaaacgtaatgaaacctgaatatttgattaacgctgaccatttgaccgttatcttgtgtcccctcgaaaaacaggataagatattggaacatttaaaaaaagaagttctagttgctaatctggaaaatttcgccatcgttcaaaaagattggccaatgtttccttacctaaagctcaaagaccatgtgctgttagatttaccagaaaagggaatcaaacaagatcgtttagcctatcaagaaaaacttgatatctcttcttcgttacttaattgtgcggcgactgagcttacgccttttgataaagtaaagcttcaattgcttcatgcgttgctttccaaacgaaacaatattgttattgaagatacatttgatgaacttagtatattggagatccaagaactgctccatttgctttcttatttagctcatgaagaaaatcaaggtattttactctttacgcatgacgctactattgcccaaagtccttacattgatcgtttagagcctgcgggttaaatcagtccttttattataagaaaacaagcgatatagaagatcgattcatgatcttttatatcacttgttttttactcttctttgatttctacgtcaggcaaacgaacagtgaatttcgttccttttcctagttcgctttctacttctaattttcctttatgcaggcgaacaagctgctgcacgattggtaaacctaatcctgattcaccatattttgtattttttcttgaaggatctactttataatagcgatcccatatacttttcatttgttgttcagacattccaattcccgtatcttcgatcgtgatgatcgtttcaagatagcctttttccagggtgaccatgatttggccgttttcggtaaattgtatcgcgttttgaataatattgaccatgatttggacaaaacggtcataatccgcataaacatcgatatcatcatcggctttcagtgtcaacgtatcccctgctgcctctgctttagcttctaactgggcaacaatattcctcaatgtttctgtaccattgaattttttaatgaccatactgatttgattcgtacggattttttcataatccaaattttcatttactaaacggatcagacgctctgtttcattcttcatcaatttaatcgcgttttctcgctgattctcagggattgcattgtattccaacccttccagaagaccgttgattgtcgtaagaggtgttctcatctcatgggaagcatctgccatgaattgtcttcgacgattttcttgttcttcgatttctgcttgagattctttcagtgaattcgtcattttattgaaatcatctgctaactcatcaaattcatctttatcatgtacgggaagctgtacatcaaaattgccattcgtcacttctttcgtcgcattccttaaacgattgatccgcttgacttggaatgctgcaaaagcataactggcaatgaccgccacaatactggaaaaaatgaaacctttgaacaggttcagtgtaattggacgaacactgttatcgatatttcgcgcaggttgactgactacaagtgctccatagaattcatgattcaaattgaatggtacaagtgcgtaagaggtcgcctgtgcttgccctaaaatgtttttattcgatgtgaatttctcttgacgcccactcctcagatttttccattgatccgttgttaaggtaaagttcagcaatgctgtattggtcggataaatgacacgttcatttttgtcgatgaatataaaattcacattttgttctgtcagtacttgctccgtcagcagcaatgcattttgaaatgcctgatcttgactaaactgcggaagtgtatcggcataggtttgcgttgtcttttcaactgattcagcatatccaaacagttgctgataattgttttcttcaatcgtctgttttgtcagttgcgtaaaagaaactccgacgatcaataagatcaacgcgaccattccgcaaaaagctaagagttgctgatacaaataacgcattaggcaacaccagaatcatcaaatttgtagccgactccccaaacagtttggataacttgtggtccgaccttttcaattttttgacgcaatttcttgatatgggcatctactgtccgttcatcaccaaaatactggtaatcccagactagttcaagcaactgttcccgagaaaatacttgtcgtggtttttttgctaaagtaaacaatagatcgaattctttaggcgtcaagccttcgatgggccgattgtccagatatgcttctcgtgttttcgtattcatcttgaaatgactggtctcaatatcaaaatggtcatctgaaaccgctgcttcttctcttgcttctgccaactcgctacggcgatgtaaagctttcattcgagcaataagcgtcagcggactgaaaggtttcgtcacataatcatctgcccccatctctaagccaatcacctgatcactttcagaatctctagctgtcagcatgataatcggcactgtgcttgaaactttgcggatctctcttcctactagcatgccgtccattgtaggcaaattcaagtccaatgtgatcatgtcccaatgttgggggttttctaaaaaggcgtcgagcccttcttttccatcatatttgaaggttgcttcccaaccttcatttaagaaaaacatctgcatcatttcagaaacagattgattatcttcaatcattaaaatattcattatcgttccctccagtttccaggtcatatctctgtaattttttttctgtcataataaaaatgggcataattggaaataccaataatagcatctcgatcaaaaaataattcgtatgtccagatgtctttaaataataaccgatcaatgtcatcagtaagcccataaggaaaaaccagttcccacttgtcttttgtgctagtcgccaatgagcgtctgtttttgcggcaagaggcgaatggtacccataaaaaggcaggtttccttttgagggcagaatccgaaaaagactgccaattattaagaataagataccaatactgaaaaaaatcattctttccctcctaaattctcttcttatagtatactctatattgttgactgaaccaatatgttcaggaattcttcacgaaaggtttgtcttttgttcattctttgttaagataaacttattccaataaaaaaggagttttatttgtgtcaaattatcgtgcaatcactttctttgatcttgatggaacattactagatgcgaagtcaaaaatcacacccgaagtggcaaaagctatgaacgcattaaaagaaaacaacgttcttcccgtcatcgccacaggacgtacagaagcagaaatccactcgatcatggaagatgcgggcattacttctgcagtcaccatgaacggttctttcattcgagtaaacggtgaagaaatctactctcagacattttcttcagaagaatgtcaaaaaatgtatgatcatgtacagttgaatgggcatgaactttcttactataacgaccagaaaatctggtgtaccggtcatagccaaacaatgatcgatgcttatgactttatccattcagatgtgccggaaatagatcctctaggctttaaagacaatacagtaaatatgttacttatcttatctcaatcgggtgacgaatactatcatgaacattttcctgagctaactttttatcggaatggtccttactcgattgatacagtgaagaaaggaatctcaaaaggcgcaggtgtcaaacgactgaagaaagaacttcaattagaagaagttcctacttttggatttggcgatggtccgaatgattttgccttgttggaagcttgcgacaacaaaatcgctatgggcaatgcctatgatggattaaaagagctttctactttcatcacaaagaaaaatacagaaggcgggattgtccacgcattgaagcattttgatctgatttaagtatattttttcgaaactggaccctttcttaaaaaatcacttattttttcttaagaaagggacagtttttatataaataatggggtatcatccgcttttttattgaatttatcccaagatatgctatactgattttgtatgaaaaatacacgtaacccttgttagctaacggggacgttacggattcgacaggcacagtcgagcttgaattgcgtttcgtaggttacgtctacgtaaaaacgttacagttaaatataactgctaaaaacgaaaacaactcttacgctttagctgcctaaaaacagttagcgtagatcctctcggcatcgcccatgtgctcgagtaagggtcctaactttagtgggatacgtttcaactttccgtctgtaagttgaaaaagagaatatcagactagcgatacagaatgcctgtcactcggcaagctgtaaagcgaaacctcaaatgagttgactatgaacgtagatttttaagtggcgatgtgtttggacgcgggttcgactcccgccgtctccattgtgagatttcaccagatttcgctagatgcttaaatccttatttcataagggtttgagcattttttattttcgcagattttcgttaaatgaatgaaaatagcattcaaaatggcattcaaaaagaacactttttaatatatatgttccatccatattatcaatgatattccacctttacaaaaagaacattcgttcgtatactctttttgaggtgaacttttatgcttatggaaggaaaaatacaattatggtttaaattcgatccttcgaatagatttatcaaagatttttataaagtatgggattcagaagttttctttttagcaatcgaagatagcttattaatcaatctctctagagagtagatttgaaagcatattactggcttacagtgttctattaagtcgagcacaacgacgttttgaaggaactttgagatattctttaggatattaaaattaactagcaccacgggtaagctatagtattttttaggaaaagggggtgttcagaaaatgaaaattttctgggcactcttttttgcaagtataatttgatcatttgtctatcttttgtgtctacaaactcgtcaaaaaatctaagttctgttaaaaatttggttttttatttataaaagtaaggagaggtttaataagcactaatttcttatgagataagccgaagttttccaaaaattcaagaaataatcttctaaaactgttttcttgaagctacttaaaaatagaatagagatatacaagaacattattatttttggaatatgtagttttggcctatcgtttttatgtaataaacgtatactgaatttttaggaagtgtttgatggagaaaaaagaggaagtactattaacaaaaaatagcttatcaataaaaactattactaaacaaagagattattggctacaaaatggttgcaaaaataaaaaagaaccgcgaatcccttgagtatcaaaggattcacgttttttttaactattcccactccactgttgctggtggtttagaagtgatatcatacacgatgcggttgacatgggctacttcgtttacgatacgtacagagattttttgcaagacttcccatgggatacgggcaaagtcagctgtcattccgtcgattgaagtcaccgcacggataccgactgtgtagtcgtaagtacgtccgtcacccataacaccgacagagcggattcctggaagaacagtgaaatattgccagatatcacggtcaagtccagcagctgcgatttcttcgcgcaagatagcatcagattcgcgtacgatttctagcttgtcttcagtgatttcgccaagaacacgaataccaagaccagggccagggaatggctgacgccaaacgattgaatcaggcatgcctaattgagtacctaattcacggacttcgtctttgaatagtgtgtttaatggttcgatcaattcaaattgcatatcttctggcagtccacctacgttatggtgagatttgatcgtttgtgctgtttctgtaccagattcgataacgtcagtatacaacgttccttgtgctaagaaagagacgccttcttcaccagcaagttttgttgcttcgtcatcaaaaacatatacgaattcattcccaatgattttacgtttttgttctgggtcagatacacctttcaacttgtctaagaagcgatctcttgcatcgactttgatgatgttcaagccgaattttccgcctagactttccattacttgttccgcttcgcctttgcgtagcagaccatggtcaacgaagatagatgtcaattggtcaccaatcgctttttgtaaaagaaccccaacgacactagaatcaacgccgcctgagagaccaagcaagacttttttgtcaccaacttgttcacggattttttctacttgcatatcgataaagttatccattgtccagttaccttcacagtggcaaacatcaaaggcaaagtggcgcaacaattcgattccgtattcggaatgacgtacttctgcatggaattggataccataaaaattacgtgttgtgtcttggatagaagcaatcggacaatctttgcttgttccgactgtttcaaagccttcaggaactttagttaccaagtcaccatggctcatccatactgtttgttgttttggtgtttctttaaacaagacagcttgatcgcttgttacttctaacaaggctttcccatattcgcggtttttagcaggctctacggaaccgccaagtttgtatgtgatcaattgcataccatagcaaatccctaatacaggaatacctaaattgaagatatcaggatcgatcccaaatgcattctcatcatatacactgtttggtccgccagaaagaatgattccctttggattcatcgcttttacttcttctgcagtaatgcggtggctcaataattcggaaaagactccaagatcacgaatacgtcttgtgatcaattggttatactgactaccgtagtctaatacgataatcttttcaacgttcgtcatatcggcaacgtttgtcaaatttattacccctatccctttaaattttatctcaaaatagtcaaactattttaaaatgctaatattttcgcatgaaaatcgaatcgataatatgattttcagttttatggagaattatatcggctcttcctcgtgtaggcaagatatattcctgtaaatttttcaaattcacatttttccatacatcttttgccattttaaaggcttcttcacgatctccgatagcaaaacgataataataattctctggattttggaaagccgtatccagtaacgcgccaaaacgatccaaataccatttttcgatcagcacgggatcggcatcgacatagacagaaaaatcaaaaaagtcgctgacgtagatttgctgattcgcaggtaattgaagcgtattgatcccctcaacgatcaagatatcaggttgctggatcagctcgtacttatccggaatgatatcatatacatcatgtgaataaacaggtacttttatctcttcctgaccagattttacacgattcaagaagtcgatcagcatctccatatcataactttcaggaaatcctttgcgatccatgattccacgctcttttaatatacgatttggataaagaaatccatcagtcgtgatcagctgaacatttcttcgtttgaaggtacgagacaaaatcgtctgcagcagtctggctgtggtactttttccaacggctacgcttccggcaatcccgataataaaaggcggtacttctacatatttatgaagaaataaacctttactcaagaacaaagattcgaattctttcatatatagatatatcagatgagcaagaggtacgtagatatctcgaacatcctgcatggaaatgcggtcattcaaacttttgatattatctagttcatcttgtgtcaaaggtgcttgcccattacgataaaattctcgccattcttctcttgccacacggtagtagttcattggatcattcatattagcctcctgcgttctcccatcaatggaactattttaacacaaaataaacacaaaccccaccacttaagagagattgccaatctttttgtacaatctttataatagaaagaaaaggagttttattcttgacttgcgcacggatacataaaaggatagactgttgacatgaaagaaacgagaaggatggaagacatgacaaatcattactattctgaacgcccagatacggcgcacgattttgaacaatgggcttttgagttaaaaggcagaacctttcaatttgtaactgattctggtgtattttcacgtgaaacagtggattatggttcacgtgtcctgattgatgcttttgattgggaagagttacctgatgaaggaaagatcttagatgtgggatgcgggtatggaccgattgggctagctttggcatttgcgacacaacggtttgttgaaatggtcgacattaatgagcgagcagtgagtctagcgcaaggaaacgcaaagcgtaaccaaatcgaacaagtggacatccatcaatcaaatatctatgaagtacttcatgaagaaacctatgcagctattgtcagcaatccgccaatccgtgctggaaaaaaagtcgtacatgaaatcttgacaggcgcatatcctcggttgaagcagggcggtacactgacaattgtgatccagaagaaacaaggagcgccaagtgcgcaaaagaagatggaagaaacatttggcaatgcagaaatcgtcacaaaagataaaggatattatatcatcaaaagtgtgaaagaataactagctgaaaaataatagagcgacgaaaaagtggaactgggcgtgcatgtaagggtacgtatcagttctttttttgttgagaagtttttaaaaacaaagaactgtttttttcttcaaaaagaaatagtaggaacagagtcgttgttttttacgataaaataaataagatacagaacttgtatagaacgctgccaagttggtagataaaggagatttttatcaaaaaacatactttctttttttctctattcttttcttgggggttttggtacactgatagggaatttagatagaagggagccactagggtgaagctgaccatcagagatattgcagaaatggcaggggtatcagtaacaactgtctcacagattttgaataacaaaggaagccgatttagtgataagacaagaaaaaaagtgttgtcgatcgtgaatgaacatcattataaacccgattatttcgcttcaaatgtgatcaatcgacattcaaagaccatcggaatgatcgtccctgatgtcactgatttcttcttctccaaactgatcgaaggtgtagagagctatttgaatcctttgggctatgtgatcatgttatgcaattctcgtcatagccaagaaaatgagatcaagtatttacaagagctttcccaccgctcagtggatgggatcttgctggcaacaccaaatattttacctgagaaatacgcattagacagcggattttatcaaaaaatgccgattattttaatcgatcgcggattgaatcgtcgggataacggacggcttatcgtaaaggaatatgagggcgcctatcaagccgtttcactatttattgaaagcggccatacgaagatcggcatgctgaaggaaaccactggatactatcaattagaagaacgtttcaacggatatcgtcatgcgctgaaagatcatggcctgccttttaatgggaaatttgttgaacatggagagttgactgtccaaggtggctatactgcatcaaaaaaattactcaaacataaagatatcacggctattttttgcgggaatgatgccatggcgatcggctgctatcaggcgatagatgaattgggcaaaaaaatcccagaagatatctctgtcataggattcgatggattaaaactgtcagaatacatgatcccgcaattgacgacagtgcagcaaccaagttttgatattggattttatgctgcgcgtttcctaatcgatacgatcgaatttcctcaaagaaaagttccgaacaaagtgttcgaaacaaaattaattattcgtgagagcgtaaaagtattgacaaagggctaactcggcggtatattgcttatgtaagcatttacaaaggcgatttggtgctttttttatttttagtaaaccagtttactaaagtggtttacctttcctaaaaataatgtataataccgaatgaagacaaggaggatcagacaatgcgaatggtggatctgattgaaaaaaagagggatggaaacgagctgtcgaaagaggaaatcgagtacatcgtcacgaactatacgaatggaaagattccagattatcaagtcagtgcattattgatggcaattttttatcaagacatgacaaatgaagaaatcacgaacttaacattggcgattgctaattctggtgatgtcatcgatttgagttctcttgaaggaataaaggtagataagcattcgacaggtggcgttggtgacacgaccacattgattttagcccccctagtagctagtgtcggagtgacagtggctaaaatgtctggacgcggtctaggttacacaggtggcacattagataagctagaagcaattcccggatttcagatcgagctttcggatgaagcattcgtgcgcattgtcaatgaaagcaaagtagcagtaatcggtcaatcaggaaacttggcaccggcggacaaaaaattgtacgctttgcgtgacgtcacagcgaccgtcgattctcttccgctgattgccagttcgatcatgagtaaaaagatcgcggcaggagcagatgcaatcgttttggacgtgaccactggagacggtgctttcatgaagaatatcgaagatgcaagacgtctggcaaaaaccatgacaagcattggcaaactagcgaaccgagaaacagtggcggtaatctcggatatgtcagaacctcttggcgaagcaatcggaaatagtctagaagttgtcgaggcaatcgaaacattacaaggaaatggtccagaagatctagtagaaatgtgctacgccttaggaagccaaatggttgttcttgctggcaaagctaaaacaatcgatgaagcaagaacgttgcttcaagaagctctggaatcaggtaaagcgttagcaaaattcaaagaaatgatccaaaatcaagggggagacccaacgatcgtggaacaaccagaacgaattttgactgcacgttacacaatggagcttcctgctaaacaaagcggagtcgtgtcaaaaatcgtggcaaatgaattaggaattgctgcaatgatgctaggtgctgggcgtaaaaccaaagaagacgatattgatcacgccgttggattgaaactgcataaaaaaattggtgacactgtgacaaagggcgagtcattattgacaatctatagtaatgataaagaaatctcttctgttattgaattattatataaaaatattgaaattggcgagtcagcaatgaagccaacattgattcatgacattatcacagaataaaaggaaaaaagcggattttaccgtttgaaagaaaaggggaaaagaaatggaactaaaccgaatgatcgaccatactattttgaaagcagacgcatctaaagaagctgtgatgcaaattatcgaagaagcgaaaaaatatcatttttactctgtctgcatcaatccagcatgggttgcgctagcaaaagaacaattacaaggcgaaccagtagccgtatgtacagtgatcgggtttcctttaggagcaaacacatccgagacaaaagcatttgaaacgacagatgccatcaataacggtgcagatgaagtcgatatggtcatcaatatcggtgcgttgaaatcaaaagatgatcaaaaagttcaaaaagatatcgaagcagttgttgaagcagcaaaagatcgtgcacttgtcaaagtgatcatcgaaacatctttattagatagagaagaaatcatccgagcatgcgaattagcaaaagctgcaggcgctgattttgtcaaaacatcaactggtttctcaacgggtggtgcaaaggtagaggatgtccgcttgatgcgtgaaacggtaggaccagaaatgggcgtcaaagcttctggcggcatccataacgaagaagaagcaatggcaatgatcgaagcgggtgctacaagaatcggaacaagcgcaggagtagcaatcgtatctggttcaactggcgaaggctattaattttcaaaggagaaactcatggcagaactcaaacaagaatggatcaacacagctattgaagcgttagataaagcatacgttccttattcccattttccggtaggtgcttgtctcgtaacagaatcaggcaagatttatcaaggtatcaacatcgagaatgcatcatttggattaacgaattgtgccgagcgcacagctttcttcaaagccgtatcagaaggagaaagatcgtttacccatttagtcgtagcagggcacacccctgatcctatttctccatgtggtgcatgtcggcaagtaatggcagagttctgtgctcctgatatgccggttacgctagtgggagacaatggtgtgacgaaggcaacgaccgttcgagaactactgccttatgcatttactgaaaaagatctataactcatgttcattcagtcagctgactgttgaaaaataaaacaattattttaggaggctttacagaaatgaaaaaagcaaaattatttggtttaggtgctgtcgcactagcagcagggttatttttaggtgcatgcggcaacaacggctctactgattcatccggtggcaaaagctcatcagacacaacaactgcagcattgatcacagatacaggtggtgtagacgaccgttcattcaaccagtcagcttgggaaggattacaaaaatgggggaaagatcaaggtctttcacgaggcaatgatggcttccaatacttccaatcttcaaacgaatcagattatatcccaaatatcgaccaagcattgaatgctggattcaaaacgatttttggtattggttataaactaaaaccagcgatccaagaacaagcaacaaacaatacaggtacgaacttcgttatcatcgatgatgtgattgacggattagataacgttgtatctgcaacattcaaagacaacgaagcttcttatcttgcagggattgcagcagcttacacgactgaaacgaacgtagtcggctttatcggcggcgtaaaaggtgaagtaatcgatcgttttgatgctggattcaaagccggtgttgatgcaggtgcgaaagaactaggaaaagaaatcaaagtattgaaccaatatgctggtgacttctctgctccagataaaggacgttcaattgctcaaggtatgtatgcacaaaatgcagatatcatcttccatgcttcaggtggtacaggtaacggtgtattccaagaagcaaaatcattgaacgaatcaggcgacaaaaaagtttgggttatcggtgttgaccgcgaccaatcagacgaaggcgaatacacattgaacggcgaaaagaaaaacttcacattgacatctacactgaaagcagttggaacagtagtagaagatttggcacaaaaatcagctgacggtaaattccctggtggtgaacacactgtttatggattgaaagaagacggtgttggtctaacagaaggacaactttctgatgaagcgaaaaaagcagtggatgaagcaaaagaaaaaatcatttcaggtgacgtaaaagttccagaaactcctgaagaaaactaaaaccatttctatagccttgttagacacatgtttgacaaggctatggtttgattagaacaagaattgttcatttatccaagctgccttgagacagtttggataagggaacaactccctgaagtaatgtttgtttcaaaagaagaacgctcactaagcgtgaatcttagtcaatcgttgccctagatagaaatcgttaggatgtgaaaaaaaggtggttcaagaaaatattgtcatagaaatgcagaatattaccaaagaatttggaacattcaaggcaaatgacaacatcaatttacaagtaaaggcaggagagattcatgcgttgcttggagaaaacggtgctggcaaatctacattgatgaacgtgctttccggattattagagccgacatcagggaaaattttgatgcgtgggaaagaagtacagatcacaagcccgacaaaagccaatcaattagggattgggatggtccatcagcactttatgcttgttgatgcctttactgtaacagaaaacatcgtgttgggaagcgaacctagtcgtgcagggatgcttgaccataaaaaagcgcgaaaagagatccaaaaagtttctgaacaatatggattatcagtcaacccggatgcttatgttcgtgatatttcagttgggatggaacaacgggtagaaattttaaaaacactttaccgaggagcagatgtactgatttttgatgagccgacagctgtattgacccctcaggaaattgatgaattaatcgtgatcatgaaggaattagtcaaagaaggcaagtcaatcattttgattacgcataagttagatgaaatcaaagcagtagctgaccgttgtacagttatccgccgtggaaaaggaatcggtacagtcaacgttaaagacgttacctcacagcaattagctgatatgatggtcggaagaacggtttcattcaaaacgatgaaaaaagaagcgaagcctcaagaagtcgttttgtctattgaaaatctagtggtgaaagaaaatcgtggattagaagccgtgaaaaacctgaacttagaggttcgtgctggcgaagtacttggtatcgctggaatcgatggaaacgggcagtcggagttgatccaagctttgactggtttgcgaaaggcagaaagcggacatatcaagctaaaaggggaagacatcaccaataaaaaacctcgaaagatcactgaacatggtgtaggacatgtgccagaagaccgtcataaatacgggttggtcctagatatgacattgtctgaaaacattgcactgcaaacgtatcatcaaaaaccttacagtaaaaacggtatgctgaattattcagtgataaatgaacatgccagagaattgatcgaagaatatgatgttcgaacaacgaatgaacttgttcctgcaaaagctttatcaggcggaaatcagcaaaaagcaatcatcgctcgggaagtcgaccgagatcctgatctgttgatcgttgcaaatccaactcgtggactggatgtaggtgcgatcgaatttattcataaacgtctgatcgaacaaagggacaaatacaaagcagtgttattgattagtttcgaattagaagaaattttaaatgtttcggatcgtattgctgttatccatgaaggagaaatcgtcgggatcgttgatccgaaagaaacatctgaaaatgaattaggtctattgatggcgggctataccttagaagaagcacgaaaagagttagaaaagggggctggcgcacatgaatgatcgcagcgagaaattccgtaatttattagtgcctgtactttcagttgttttaggattaatcttaggcgcgatattgatggctgcttttggttttcagcccatccaaggttattcttctatgttagatgcagctcttggttcgcaaagaggaatcggtgaaacattaaggcaagcaacgccgttgatttttacagcattagggttttctgtagctaactcagctgggttcttcaatatcgggctttctggacaagcgctttgcggatggatcgtcagtgtctgggtggcacttgcttttccagatcttccaaaagttgttttgcttccattgtgcgtgatcctaggtgccttagcaggtgcgatggcagcggctgttcctgggttgctacgagcattttttggaacaagtgaagtgatcgtaacgatcatgatgaactatatcttattatacgtaagcacgtttgctttacatgaagtgatgcctgaaagctaccgatcaagtttggactcttccaatatgatcagtcaaaatgcatcgttgcggttaccttggttaacacaagcttttggcggctctcgcgtaaactcaggtttgtttttagcaatcatcgcgcttattttcgtttggctattgatgaagaaaacgactttaggatttgagatccgttccgttggtttgaatccttttgcttctgagtatgcagggatgagtagtaaacgtacgatcgttttgtcgatggtcatttctggcgctttggcggggcttggcggtgtggttgaaggattaggaacgtatcaaaacttcttcgttcaaacgacctcgctatctattggatttgacggaatggctgtctccttacttggatctggatcagcaatcggtattcttttatcagcgattttgttcagtattttgaagatcggcggacttggcatgcagacaggagctggtgttccgtttgagatcgtcaatgtatcgattgctctgattatcttctttgttgggatcaatttcttgattcgtttcgtcatggctaagttcttccaaggaaaaaaacaagaagaaatcgttgcgacaatcgaagcgaagccaacgtatcaaaaccatgaaggaggcgaactataatgtcgactatcgaattaattgccttgattcttacttcaacactggtttattcaacaccgttaattctaacatcactaggcggaacgttttctgaacgcagcgggatcgtaaacgtagggttagagggaatcatggtcatgggtgcttttagttccatcgttttcaacttgacgatgagcccctcacttggttccatgacgccatggatcgctattttagtgggtggcgtcgtaggtatcctattttctttgatccacgcagtagcaacagtcagcttgcgtgctgaccatatcatcagcggtacagtgatcaatctgatggcaccagctttaggtgttttcttgatcaaagcatggtatgggaaaggtcaaacagataacatcacgcagaatctgggatatttctctttcccaggtttggcagatattccggtcattggatcaattttcttcaaaaatacattcttgcctgcttattgtgcaattttgattgctgtcattgcttgggtgatcatcttcaagacgaaattcggcttacgcctccgttcagttggtgaaaaccctcaagctgccgatacattaggtatcaatgtatatgctatgcgttattcaggcgtgctgatttcaggcttgttaggcggtatgggcggtgctgtttttgctcagtcgatttccggtaacttttcagctgggacgatcgtcggacaagggttcatctccatggctgctatgatctttggtaaatggaatcctttaggcgcaatgggtgcctcactgttctttggttttgcacaaagcttgagtatcatcggtgcacaattaccagttatttcttcgattccaccagtattgctgcaaattgctccatatttgctgacaatcattgtgttggttgttttcttagggaaagcttctggaccaaaagcaaacgggaagaactatatcaaatcaaaataatcttttagcgaataaaaagggtgggttacgggaagtgtttttcgtctcgccctttttgttttaaaggtaataaaaataaaaagaaagaaggaataatcatgtttaaacgcgtacatctgatcgtcatggattcagtaggaattggagaagcaccagatgccgagaagttcggtgacgttggttctgatacattaggacacattgcaaaagaagcaggattgaacattccgcatttagagcagcttggtttgggaacgattcgtcctcttgaaggtgtggaatcagtgaaagatcatcaaggctatgcgacgaaattagaagaagtttctgtagggaaagatacgatgacaggccattgggaaatcatgggattgaatatcaagacgccgtttcgtgtgtttccgaacggattccctgatgatctgatcaaacaaatcgaagagttttctggccgtaaagtcgtatgcaacaaaccatatagtggaacggctgttattgacgattacggtgaacaccaaatgaaaacgggtgatttaatcgtatatacttctgctgatcctgtccttcagatcgcggcacatgaagaaatcattcctttagaagaactataccgggtttgccaattcgttcgtgatataacaaaagatgacccgtacatgattggtcgaatcattgcacgtccatatgtgggagaaccaggagacttcacacgaacaagcaatcgtcatgattatgcgttggatccattcggacacacggtcctcgattctttgaaagaagcaggaaaagacgtgattgctgtaggaaagatcaacgatattttcaatggacaaggaatcactgaatctgtccgcacgaaaagtaatatggatggcgtcgaccagttgctgaacgttatgaaaaaagagtttacaggtatcagctttaccaatttagtagattttgatgcattatacggtcatcgccgggatgtagtcggttatgcgcatgcgattgaagaatttgacttgcggatcccagaactgcttgaagccatggaagaagacgacttgctaatgattacagccgatcacggaaacgatccgacatttactggtaccgatcatacgcgagaatatgtaccgttattggtctacagtaaaaaaatgaaagaacaaggggcgttgcctcaagggtattattctgatatctccgcaacgattgctgagaactttagtgtttcttcgactgaaaatggcgaaagcttcttaaaattattaaaataatctttttaaaataggagaaagcaaatgaccaagttaagcgagatgttacaagaaacgacccagtttatccttgataaaggagtaaaagaaattgattttggtttgatcctaggttcaggattaggtgaattagcagatgaaatcgaagatgctgtaatgatttcttatgatgagatcccgttctttcctgtttcgacagtagttggacatgcaggacagctggtttacggatctctagcaggcaaaaaagtgttagccatgcaaggaagattccactactatgaaggtcattccatgcaaacagtgacctatccagtacgtgtgatggccggactaggtgcccattcagtcattgtgaccaacgcatgtggcggtgtcaatgaatccttcgtaccaggagatttgatgctgattaccgatcacatcaattttactggtgaaaatcctttgatcggcccgaatgaagatgaaatgggtcctagattcccagatatgagtcaagcatatacgcctgactatcaagcaacagcaaaagcagcagcagaaaaactaggtttggatcttaaagaaggcgtatatatgggctactctggcccaacttatgaaacgcctgctgagattcggatgtctcggacaataggagccgatgcagtagggatgtcgactgttccagaagtcatcgtagcagctcacagcggattaaaagtgttaggaatctcttgtattaccaacttagcagcaggcatgcaagcgaatctgagccatgaagaagttgtagaaacaactcagagagtcaaacaatcttttaaagcattggttaaagaaacattgacattattgtaataggaggagcaacaaaatgagtgtgcatatcgaagcgaaagaaggcgagattgccgataagattttacttccgggagaccctttgcgagctaaatatattgcagagacttttttagaagaaccagtttgctacaatcaggtccgtggtatgctaggctttaccggcaaatataaaggcgaacgtatttctgttcaaggaacagggatggggatgccatcagccaccatctatgcccatgaattgatccagtcatatggcgtaaagaaattgatccgagtaggtacatgcggggcattgtcaaaagatgtccatgttcgtgatttagtactagcgcaaggcgcagcgaccagctcttcgatgatcgaaaaaaatttccaagcctttcattttccgccaatcagtgatttcaatctattactgaaagcatatgagatagctaaagaaaagggctatacggttcatgtaggaaatgtcctttcggaagattctttctacaaagatgatttgacagagacattccaattagctgaacttggtgtcttaggagtggaaatggaagcagcggctctctattacttaggcgcgaaataccatgtgcagacattaagtttgatgaccgttagcgaccatttgattactggggaagaaacaacagctgcagaacgtcaatcgacattcaatgaaatgatcgaagtaggattggaaacggcgattcaagggtaaagtaatagctaaatagcaagaaagtgtgactgcctaaacttctattaatagaaatttggcagtcacatttttttgcagaaactgtctcacataacctgaaatcaatgacaaccgttgcttcagttacttcgagggtccttctaaagtcaaccatttgaatgtctaaaatgtgaatcgatattccttttaaattgcagacgaatggcacaatcttaatcaaataaaaaagaacagaaagaagcgagttacgctctttctgttccgaactaggctaccaacaggatgtgacaaatgagtcatctcctgttggtggcttcgtctagatgaataccttaatcattcaattgctcatgtgatgatgcttgaagaatgaaaaattcaacttaaatcaagtctgcatcaataataagtgtttcgaataatacagcgtgctcaagtgaggtgcctgatccaggacgtcctggtaggcgatatacttctattcgctgtcctgcttttccaggaattccgtgacgtacttgaatattaccatcaactattcttggaatgctatagtatgctgtgccgtcaaatgttccaaaacgatatcttccatcaatgtgaacgacccatctgtcttgattattgtgaaaaagttcaggtgtcaatgttaaataagcaaatgcttgagaaccttctcgccctacagacaacatgtttgtttctgttacgcctgtttccacttggatattgtcatatttcgcccaaccattccatgtagaagcaaatcgtataaggtatgtattttcatcgtctggagtcgcaaaagtaagtttgccacgttcccagttctcattattatgttcactgcgttctaatacatcaaaaccgacatcatgattcatgatccctaattcaacacgtcctggtgctgattcgcttgctgcaacatcataactaaatgtatacgtggtacttggttttaatgtcacatattgatgaacattttcaccattttttgctaaagcaaagttatttccattaacggtttgaagtgtgggattatttggctcttggccactagtgatccaatgatcaaacccgtcattaaagtcaccattatggatatacaattgttgctcaatggcctgtttacttgtactaacgaagtcagttgttgatagacttgttgcgaatgtcgaaacggatcctcctaaacttaaaaataccatacctgctgccatcactgtttttaaattacttttgatcatcttgtatctcctcactctatatttttattttttgattttgtttgtaagatgcagccgtgtagtctgtctgtatctcacaaattaatcataaccgagaaaatagcggtcgtgtaaacacttttttctatataacattcatcattagaaaaaaatgataaaataaatagttttataaggttgacttttatctaaacttcatttattagcaacataagaaaagatggagagttgtggtgatagctcatacaaatgaaaacttcctcttagaaacaggataaaagaatgaaatttaaataagtttctacaaaaaatgttcgctccacatctgaatgattgtcagacattcttttttctctcaatgctacgccttctctcttaattttttgtttattcaaacagtacttactattataatcatatagttattacccgtggtgctagttaattttttcctagaggaaaatgtctaaacatgttggtaatatcaaaagtatttatcatttaattatactgaaccaataaatagtctatattttaatattactaatgttcatggaactttgaaatctagacgtataattttcggaattgatcaaacaaaagttaatcctttagaggaaatttatagatttactaaaacttttagacaaatgactgaaacttctatagcaaaaagaagtgatgagcttattttgccaagaaaagaagaaattaatgaaattgctttttttggacattcattgagtaaattagattattcctattttcaaactatatttgatttttatgatttatatagttctgatgtaacattagctttttattatagattatatgatggtgttactaatttggaaatggaattagatttgtctaaaaagattagtgcaatgcttaaagattatagtccaagcattggaaatgaaaataaagctgataatttaatgcataaattattattagagaaaagactagttattgaagaaattagctaatagcgtatgatataatagaagagtagaaaagtgaaaagatggtggctaatctcttaaaaaaggggtgatgcctatggttcatagctttatccctagaagggagtaagcaagtgtcaacttttgaagcaattcaactgatgatcgcttttgcgacgttagttttgctgataattgaccataaggacaaaaaataaccatctaacactttgacagaggatagatggtttgcaaaaaaacattcaattcaaagtcaccgtctttttaacggttctacaaaaggaattggggctatgttcgagcatagctcctttttcttgtctttagtataccatattccgtgtgaaaaatacaaatagcttgctactaggagaaaaaatgccaaccattaaatttgatgattatttagaaaaaagattaaaagaaccagaatttaaaacgaattttaagaatgaaaatgctaaattaaatattgctcttgctttgttggaagatgaagacactgttaattcaattgtgtacgtttgaaaacaaaaaaatgaaggaaggctttccgctcagggctggtaacccgtctacaaatagtttgctactagtatataaaatgccaatcattaaacttgataattattaaaaaaagattgggataaccagaatttaaaacaattttcgagacttaaaatataaactaatagtgtcatcactttgaagagggctaaagaataatatatttcttctttttcttattcatgtactacctttcacttattaattataaggtagtacatatatatatttttttttggtagtaactaaaaataaatatgttataatagtatcaaatgaatattgctaaaagaaaagaggtaggaacgtggtagcgaagaaatatgtaatcggtaattttaaaggtggcgtaggtaaaagtacatgcgcgcaaatgttaggttttgaatcagcagttaatgaaggaaaaagaaccttgataattgacttggatatgcaaggaaatacttctgatgtgatgaacttaacgcatatgaacttcactaacgaagaaggaggcggagaaggtgaaccgattgtttacgaaaatactgtgactgacgtgttgataaacaatcttccacctaaagaggctgtctataaagtaatcaataacctctatatacttccagcagacatgtcctttgaaatgtatgatgattggatcaaagaccaatataatgattcattatcccaattcaaatatatgaaagaaaagctagaaccattatttgatgagtttgacgtcatctatttagatgtcccaccttctatttctgtatatagtaaatccgcgatgtacattgcggactgggcaatcgtcgtcttacagacccaagtaaaatcgatgagaaatgcgatgcaatatcttgagtatatggacttttttgtgaaagaatttgatacaaatttatatgttgctggtgttattcctttcatgttggaaagcggtgacgcagtagatcaggaaatgtataaacaagcccaagagatttatggggaacatttgattaaaaatgttgtactcaaaaatgcgcgcttaaaacgatacgacggatcaggtattacgatggagaagacaaagaaaggtctcttaaaacaatgggatcgcaaaagccacgaattatttatcagtattttgaaagaattggaagaacacgagaattggtatgcggaggtggagtaattggctgacatcaaaggacttgatatttttgggaacaacaaaggactcgccaaaataaaaaaagaagcagaagcaaagaaaaagcagcaagcaattacaccatctgaaaataagcaattagaagtgcaccaagttcaagaaataaaaacttcctccaatgttgaaagacagagtagaggaagaacaaaaaaagttggcgcaccaatcagaaagtttgataaggtttattccaccaagcatcctttaaaactgtcgactttgttaaatgcgacttccagagttttagtagaaaagtatgagactaatatgacaagagatgaattgcttagaaaagctttagatgagtatattaaacagaatcttacgcaagaagataagcaagatttgtttaatgacgtggtgaaagaactagacttgttcagagaaaaatatccaattgttccagaattagatgatcgtggagaaataataagaactaccagtcagataaaacaagataccgaagactcactgcgcaaagggtggggaatgaataataaagttagataataatcaaagaagaactaagtaactacctttaaacggtagttacttagttcttctttgatttgcgtgaaatagaggggatttatttttctggttacgtgattaaaaaatccaaaaaatgagcataggaacggttatgattttagggtgtgttttaatgagacattgtgatttcattaacaagtgtataataatctgttgttgagttagtaaataagtaatagagctaactctaaaataaaactattaggaggagatgtagatgaaaaagtttaaaaagaaaatatatttaggattggttgttggggtgagtatgtttgggttcatggctcatactaaacaagtaactgcagatactaaccaaaaagaaaggattatgagccaattagatgactctcaaatagagtatgtacccaatgagctaattgtcagtttaaaggctacacaaagaatttcaacagagaaaaataaaccgcaaaatttattgggtgtaaaagttatggtggaaaaagatttgactcttaggacaaatgaaagcgattataataagcgagatcaagtattattagtgaaattgaacgaagaaattagtgtggaagaggcagtaagaacatttaatgcttctgatatggtcaattatgcagagccaaactatgtggttgaactagagccgttgaatgatgttgaggagccaaatacaactgattctttaggaaatcgatcaattattcttaacgatcctaattggagtaaacaagctaatttaagagagattagcatgccatccgcttgggaagaaaccaagggttctaaggatgtgaaggtagcggtcattgattcaggaattgattatcaacatgaagatctttctggaaatgtagatgaaagtttgagatacgatttttttgacgatgatacagatcctatggatactatgggacatggacacatattgccgggattattggtgctcaaacaaacaacgaattaggtgttgctggaataaattgggatgttacgatggtacctatacgtgtatttggtagtagtggaggtaccagtttggcaatcttaactgaagctattaattatgcatcccaaaaagggtttccaattatcaattttagtataggtagtgttgtttatagcagtacagaagaagcaattaaaaactatcctggattattcgtagcagcagctggaaataatgggatagatatgactgataaacctttttacccagcttctttggatatacctaatattattactgtaggaaattctagtggttatgaacgaagttctgattcaaattatagtaaaacaggtgttgatttattcgctagagggtttcgtgtttttagtacatttctaggaagtaaatacacgtatatgtcaggtacctcgatggcaacacctcatgtcactggtagtgctgcattagcgttgtcactagatcctgatctatctactgatgaattaaaaaaaatcattttaaatagtgttgattcattttatgaactatctgatttatgtcttacagggggaagactaaatacgaataatgtcgtacgacaagtaacgggtaaacttactgcatctaatatcacattaagattaaatagtgaatggtcagatgaaattgctaaagagatgtgtcacgttcactggattgaccagtcaggaaatgatttgacggatcaagtggttgttctaaaaaacgaagtggatacatctaactttggcgattacgaagtagtatttgcatcacctgatttaacagatcaaatctcagttacagtgaccgtacctcgattacgtaaacttacgctaggaaaagaaacagcaaccattgatattggttccgcatgggatagtgtcatagccattgatacttttcaagtgaaagctatagatgattttgggaatgatgttacaaatcaagtacaggttactattaatgctgatatagatacaattaattcaattcaagcagtgattaagtttgaagttccagaattaggcttagcccaaattggtagactgaatattactgcaaaaaatagtacaatcaatggattgaatgaagttagcatcgagcacgtaaaaaagattatgtcgttttcgaagaagaatttggacatttagagggtgatacgattgtcggcatccaccataaaagtgtcgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataataaccatttggttttcgttttccttgcatcggtaaatgtaaaacattgaattctcccgtcttaaaccggcgatagagggtacttactgaacaagagaaggttcgctctgcacggccaataatgacgtctggggtccaaccttcagttgatctttttgcaatgtattctttttcctcagcaggaaaaatgatttcggttctcccacaacgtcgcttattttctttgtattgttcaaggtattcaagtgctgttccaccacatttgagaaagttatagacattgtaaattgtttggcgtccacgtttaagctgcttcgcaacgatagcaaccggagtttcttgatgaaaatatgcttctatcattacaagctcgtttggtgtaagatgggtataagtcatttatgttcactctccttgtatgctttagcgggtattacaatttgagtgtaacataaatggcttttttatttgtctcgcttaattatacaaacggcgagaatatcgacaagactaggatatttttttatatatgcatatccttgtggtgcagtaactcctaaattttttaaattagacagacttattggtaaaagtatttcttctaggtggataatttcgtaagcatattttcccttttaaactaattgttcaaactcatcgtctcctaaaaagtagtgttgatttttcttaagtttagtaattggattttttacaatcaatttatactttaaagctttggtggggattgtttcgtaaatccaaaagatattataaggatctgaggtaagatagaaatttctaaattcaaagtttttttgtttgtttataattttttccatgtatcgtggatagatactaataaggatattgttagtcatcgagtgtccataattatcgtgtggatttttcattaatataagctaaataactattttcagttaacttagctgccagttccttactagcttcagtcatttctattaatgctttccaattggggatagggctatccaaaccagaaatttttgtcgacttatttaaacgattccattttctaattgttgttcctactcttatagctgaactcgaactgctttctgtattgtatttatttttcacttgtaaaagaattggtgaggttcctaaataacagaaatcaacagctcgatatacagagccggcgcaccaaatccaaccttcaggttctaacacttcggctaaatattcctctaaaatacttccgttcatgttctcagcgctcatatataaaaaatgtccacgcaagtagtcattcaatactttttgatcatcaatattagcatttgctgctactctagtagttaaagcagcatctttttcgccaaatgttttaagaggtttttttaatgctgggttattcctatccctgatgtatttattacaccattttgttaagtaaatttttgccataattaatggattatcactatcaggtactgatataccagtggtccattgttgagtgcaaaataaaaaagttcttttaaatttttatgatacttactatcttcaacgtcatcgataacttcatcaaaaataatggatgccggttctgtggttaaaccttcatttaagattgattcaaaagttctatttttgttaggcatatacgtcacgtagcttgttatcaagaataagattctttcttttttttttgctttttctaaaagggagtatgctaaaataagagggtatatagcaactttaaataagagataggagtgtatctttttgggtgcagaattaaatcaaaaattatttagtgcggcagataatctccgtagcaaaatggatgcgtcagaatataaaaattatttgttggggttgattttctataaatatttatccgaccgtttgttggaacaagtggttcttttagcagatgaatccttagaggaatatgatacggtaagcaaacaaacgatgttgtatcgcgaattactttcagatgaagaatcaaaagaagatctgattgcaacaatcgttgatattttggggtatgcgatttcgccagagtatcttttcaacgtcttagcggatcaagcaaaacaagcaacgttccaattgaatgatctaaacaaagcctttgtgcaattggcatctacctacaatcaatttaatgggttatttgatgatgtggatctccaatcaaaaaaactaggaacagatgagcaacaacgaaatgtgacgattaccgaagtcattaagaaattgaatgacgtggaagttttaggtcacgatggggacgtgatcggggatgcttatgaatttctgatcagtcaatttgcttcagaagcagggaagaaagccggagaattttacacgcctcatatggtttctgatatgatggcacaaatcgtgacgttggatcaaaaagaacgacgattctttagtgtttttgatccaaccatgggttcaggttccttgatgttaaatgtgcgtaactacttaactcacccagataacgttaaatatcatgggcaagaattaaatacaacgacatacaatctagcaaaaatgaacttgattttacatggggtagatgccgaagaaatgaatctccgcaatggggatacgttgaataaggactggccaacagatgaaccttacacatttgatgcagtagtaatgaacccaccttattcggctaattggtcagcagatacgaccttcttagatgattctcggtttaatcgttatgggaaattagcgccaaaatccaaagcagattttgcgtttcttcttcatggtttctatcatttgaaggaaacaggtaccatggccatcgtcttaccacacggagttttattccgtggcgctgcagaaggggtcattcgtcaaaaattattagaagacggcagtatttatgctgtgatcggtatgcctgcgaacttgttctttggtacatcgattccaacgacggtgattgtattgaagaagaatcgtcaaactcgagatgtattattcattgacgctagtcgagaatttgtcaaaggaaaaaatcagaataaattatcggaagaaaacattcaaaaaatcctcgaaacctacgctgaaagaaaagatgtcgagaaatacgctcatttggcaacctttgatgaaatcaaagaaaatgactataacttaaatatcccacgctatgtcgatacgtttgaagaagaagaaccaattgatatggttcatgtcggaaatgacatcaagaagatacgacaagaacagcatgtgctagaaaaagaacttttagaagctatctcttccctgcaaacaacacctgaaaatgaagcgtggttgcaaggtgcgctggaggtgttcaaacatgagcaatgatacacgaccagaaatccggtttcctggttttacggaagattgggaagagcgtaagttaggagatatgatggatgttacttctgtgaagcgaattcatcaatcagattggactaactcaggtattagatttttacgtgctcgtgatattgtctcagctgcaaaaaatgaggaaccatccgattatctttacatttcagaagaaaaatataatgaatattcgaaaatttcaggtaaagtttctcaaggagacttgcttgtaactggtgtcggatcaataggtgtccccttattaatcactgatgataacccaatttactttaaggatggaaacatcatttggttcaagaatgagcataaaattgacggaaacttcttttactactcgttcataaataataaaattcagaagtatatccgtgacgttgcaggcattggaaccgtcggaacctatacaattgatagtggtaaaaagacacctatctcacttccaacttatgacgaacagatcaagatcggttcatttttcaaacaacttgatcacactatcgctcttcatcaacgtaagttagatttgctgaaggaaacgaaaaaaggattcttacaaaaaatgttccctaaaaacggagcaaaagtgccagaaattcggtttcctggttttacgggagattgggaacagcgtaagttgggggggattggtaaaacatacacaggtttaacaggaaaaagtaaagaagatttcggacatggtgatgctaagtttgtcacttatatgaacgttttccaaaatccaaaagctacacttgaacaactagaaaacgtggagattgaccctagacaaaatgaagtgaaaaaaggggatgttttctttacaacctcttctgaaacacctgaagaggttgggatgtcgtcagtatggactcatgatatcaataatatatatttaaatagttttacttttgcatatcgtccaacaataaagtttgatttggattacttagcatttatgttaagatcgcaatctgtgagaaagaaaattatattcttggcacaaggtatttcgagatataatatctcaaaaacaaaaatgatggatatttctgttcctataccagttaactttgaagaacaacaaaaaattggtgccttcttcaagcagctagatgatacgatcgctcttcatcaacgtaagttagatttactaaaagaaacgaaaaaaggattcttacaaaaaatgtttgtctaggagggaagaaaaatgaaaattagtcaccgtgaggaagcgaaagtcgaagagcagttgatccgtgtattgggggaagggcataatcagtggacgtatcgtccggatctaaaatcagaagaagatctttgggtcaatttacgtcaaaaaatcatctcaaataatcaagcagaactgaatgattctcctttgaccgataaagaatttgaaacgatcaaaacggaattattgctacgaacgaaaaccccctttgatgctgcgaaatggttaaaaggtgaaaatggaatggctcggatcacgattgaacgggaagatccgcaattgggttctgtctcacttatcctttattccaatcaagacattggtggaggaatctctacctatgaagtggttcatcaaattgcaaaacgtggaagtaacatagaagcacgggatcgacgttttgatgttaccttattaatcaatggattaccgattgtccaaatcgagttgaaacaagtaaccgcaaaagatggcgtctatcaggcgtttaaccaaatcaaaaagtatgcagaagaaggcatgtttcggaacaatatcttttcgaccttgcagttgtttgtggtttccaatgaacaaacgacccggtattttgcaaatgccttaccgaaagacttgcaccctaagtttttatttagttggcgaacgaaagacaatgaaaaagtagaaaacttatatgagttttgtaaacaagtgctaaatatcccagatgctcatcgtttgattgcggattatacaatcgtcagtgaagatcaagacaataataccctcatggtgttacatccttatcaagtgcatgcgattcaagccttgtttattgctgcaaataaacatcaatcagggtatgtatggcatgcgactggttcaggaaagacgttgactagttttgtatctactaagcttttagcacgaaaatcggggatcgatcggacgatcatgttagtggaccgcaaagatttagataatcaaaccaccgcagagtttacgaaatttgcttcggaatttaatactgggatttcttccgggaatgccaaagcgaatagcttgatcgttggaacaggaagtgccaaagagttaagtgaaactctgttggcagatgccaatgcaaatgttgtaatcattacaacccgtcaaaaactagatgcggcgttgaaatatgcaaagaaacaagaagagaaaaaaggaaccaatcgcttccaaaaattaatgggccaacatatcgtgtttgtagtcgatgagtgtcatcgagcgttaagtgctgaaaatatggaagaaatcaaaaaaatgtttccgaaatccacttggtttggctttacaggtacaccaattttccctgagaatcggaaacaagccaaagggcaattagcacgtacgacccatgatcagtatggagaggtcttgcatacctataccatcaagaatgcgctagaagatggctctgttttaggatttcaagtagagcatgaaaacaccgttgagccgacttcattagagaataaaatctatcggaaattaaaagaagtagaaacatatgcagagtattcatcagaacagatcaatcgtatgatcgatcaaatggagcctgtcaaaaaagaaagttatttggaccctgctgtttttgaagcagatgaacatatccaaaaagtcattcataaaatgttccgtccagataatgcctatacaaaatttgattttcgaaatggccgtccaacgaaatctgcaatcttaaccacgagttccattgatatggccaaaaagtattatcgggccatcaaagagatgacgaaagaatctgattggttaataaaagagtttcccaatcagcctatccgtgaaggacgaacgatggaggatcctgattttccacgaatcgctattacctattccttagaagaaaatagccaagattcaagtgtcaaacaagaagaaatgcaaaaaattattgaggaatataatcagtattatgatactgcctggtcactagcagacattgagcgttataacggagacatcaataatcgtttggcacgaaaaagagcggaattcaaacaatttgggaaacaaatcgatttagtgatcgtagtggatcgtctattgacaggttttgacgcccctacgattcaaaccctatttgtggatcgtaatctagagtatgcaggattgatccaagccttttcacgtacgaaccgtacgtatcctgaaaaaacaaaaggactaattgttactttccgaaagccagcgacaatggagaagaatgtcgaggatgcgacaaaactgtattcagaagctaaagaagaatcgggtttgatttatccaagttaccaagaatccaaaaaaagattcaagcaagcatatggtaagttaaaagaggtttcatccatggaatccattgatgaacatacgccacttgaaatccgtatcgagtacgtcaaagcatttcaagaattgaatcgtgcgtatgaatcgttagtgacttatgatgattacaatgatgacatggtgcaatcttcaactttgaacaatcaaattcaacttttggaagaacaaattggcgtgtacgagaccgtgaagggttcattgatggaggaagaaccagaaaaagagggagaagatttttcaacgatcgaattttatagtgaaaataccactaagttgtatgatattgattctacttatattgatcaattactaggaacttatgctgcaaatagttcagatgcacgagaagaaattgaaaaagctttggctaaattgaataaaacagaaggagtcaaagaagtttaccgacaaattttaaatgcatttgatgtggggactttagatagtaatgaagatatctttgtcattaaacgtcgctattttacacaagcaagtgatgatttgattcatgccttttccaatgagtggtttgtctctgagaaagaattacatgcttctaatctgcaatatctaccaggtgaagatccaattcctaatatgaaagcaattatcaacagtaaggattacgaaggatataaagccaaacatccagaagcgaagccatttaaatacccacaagaaatgaagcgagcatggcgtaaaatgttagatgatgagttgattccacttgagaatgaattgaggtaaacgagaagagttaagaaaattgtatgataaacatgttaataaatgatgctcgaaataaaatttggttttatttttacattgatacggtaaataaaatttgaaagtagaagaaaatatgcacaacaatgaaacaaaaaaaacatatgaactaagaataactgctgatgagattaaatcaacagacccaacatttactatgaagaatctaagcttaggggataattatcaaccaaaagatgcttacttccgtacggcagaaggcgaaataactagaagaaactacggtaaaaatgaacggaaaatttcaaatcaaacattaccgcgattagctattcaaatgtttgaacgatcgattgtttctctaccagaaagcgaaagagcaacatttcctgtgtgtcgatatcactcaggagatgagataatacgaggaatttttaaagatgttgacagtttcaaaaaaaaaaggaagtccattgaatttttgatttataaatataatgaagacaagcagatagtcatctattgttggagtattttttcaactttattatttgtacaagaatgtttgaaacgttttggaacatctggggatgaatttattcttgtttataaagggaaagagaaaaaggaaatacgagtaggagagactcagactatgaccaatcatttgctgaaatcatatgtttcacatttactcaaatctaaaaaccttattctacgtggcgctcctggaacagggaaaacattccttgcaaatgaaatggcagctgatgtcgtttcaaatggcagaactacacaaatcaatgaattgagcgaagatgaaaagagccgaattggatttgtccagtttcatcctagctatgattatactgattttgtcgaaggtttacgtccaactacatccgatgatggcgttgttagtttcaccttgaaagatggaagctttaagagctttgttgaaaaagcaaagaaaacaaagaaagtaaatggacaagataattttgaagaagcttgggctaaattttttgatgcggtaacggaagctagtatagagggagaaggctacaacaaacttaaaacattgacaggtaaaccagtacgcaatcttctagcttatgaaagaaatgaaattcaaggtgtttatcctgctaaaaccaatacttatctaaaccatgaccaaatttataatgtctatcgtggattgcctggtacgccaaaaggtggatttgatgcttatcgaaaagcgattgtaaaacacttaaaagaagaatttggcttaaaaaactacacggcgtcaacggtagattctacgaataaccaaaactatgtgtttatcattgatgaaattaatcggggcgaaatttccaaaatttttggcgaattatttttctcaattgatccaggatatcgtgggcataaagaaggtgtttacacacagtatgcaaacctccatgaaaatccagaagaaaaattctatattcctaataatgtttatattattgggacgatgaacgacattgaccgttctgttgacacttttgattttgctatgcgccggcgatttactttcttagaaataaaggcagaagattcagcacaaaaaatgctgaaacaagagaaaacaaaaaaacttatgatgcgcttaaatgaggcgatcgttgccaaagaaaaaggtggactgtcaacggattatcaaattggtgctagttactttttaggtattgataatggcgaggagacaatggaacaattatgggatactaagttatatccattattgaaagactattttcgtggtgaacataaggcgacagaaaaattagaaatactaggaaaggtatactctaatgacggtgatttagatgaagctgaaacctctacacgataatcaagaaatcaatggctcaattgtgcaacatccaatcattacgaacttagttaatcgtgacttaagtagtttagagaaagaaaattttattatctttccgcaacagttaaatcaatccaaggatctaagtgaagataacttgatatttcaatcaagaaatgaaaaaatttggacttgtaatgtcgtaggtatccttagcgattcaacagatgaattaagaattcattctagattcgctaatcaaatgaagcatgaagatttctttttacgttatatgcttcagcgtgttttgaattacaacgtgattaatgatcattttagtgcatctaaaaagatgacatactacgatttgttggtatttctctttccttattatctgaatgaagcaatgcgtaaagggatatacaaagaatatgtcaaacgagaatacaataatgccaatatcaagggagctgttgatgttgcaaaacacatccgttcgaatgttcctttcgttggaaaagttgcttatcgaacacgagagttcagctataataatcatctgacgcaacttattcgtcatactattgaaaaaatccaaaatgagtatgatttcttacttagtggagatgaggatacgaaagaaaacgtggttctaatcaaacaaacaacacctgattatgctagattaaaccaatttaatatccttcaagagaatatctttcatccagtcaaacatagttattacgaggagtattcggctcttcaacaaatctgtatccaaattttatcggaagaaaaatcaggatttggaaatgataaaaatcaaatacatggaatcattatcgatgtgtcttggctatgggaagaatacattggaaaagtcactggttggaaacattatggcagagataaagggttagcaacaatgcatttatttcaagagcccaaccggtccccacgatatccagattttacatttaataatataccaattgatacaaaatacaaaaaacatcttgatactagaaatgactataatcagttagtcacatatattcatataatgaatttagaccaagcagatacaataaaaggcggctttctgcaacctacttccgatccccttcctgcaaatcatgggtataaaaaaataggcatattaagcgggctaggaggagaaatattcacatatcattttttcattccgcaagctgcgtcaagttatttggaatttgtagaacagatgagagaggtagaagcagcactacaaactacttttcaataagtaggaattatagaaatgttactcaaaaaatcttcattaaaaaatctgactaaataagttgagaaaacagaatatacttcaatatccagtgatttataaatatcattcactcatgatacccagctccgtatcacaaataatgatattttttaagagaaaaaattatccctattttaaataatagcaataggtagtggtagagagaaatttataaataactttgttatttgctttggtagccaagtaagttgcaaaagaaaaatagatactgttaaaaagataatgtagacatagaaacaaatacgtaaaattttagttagaatgatggcaaggagaaaaaacatgatagatgaaaaaaagtgtttaaaaaatctattggaggatatggatgatattgaagaaaaactatctaaatggactgggaaaacaaatatatttcagaacccgtggtgctagttaattttaatatcctaaagaatatctcaaagttccttcaaaacgtcgttgtgctcgacttaatagaacactgtaagccagtaatatgctttcaaatctactctctagaatgatgatgataaatattttgcgaacaaactgtttcaatttatatttccagactattcttcaatgccattttttacattaataaattttatgctgtatgttaaagaacacttaggatatgatgatttagtagaaatgataaaggcatatgataaagaaccttatccattcaaaggaatcaatactggttcagatatggctatgatttcaggcgaaactgtagaagaaattctagctaattacaaagaacaaaatataaaaactctggaattaattaaaaagaatataaaatactatgatcctttactagcgaataaagaaaatattgatgagttattaaatgcaattgctgattctgatgttagatctcctagaattgatgagttaaaagaagaaattttaatgtataaagaacttttttaattcatttgattactgttatactcaatatcattcttaattctgtaaatagtttgtctagtaatattgtagtttttagcaatttttgaaatagctatgccctcatttaaatccttaacgatgttttcataaactaaacgtcgttgaggattttttgtatctgcactatagagttttggacgacctttatagacgccatttgcttttgcaattttaatgccttgcgcctggcgtcgtttagattcggtacgctcttgctctgcaatcatggccaaaatttggatgattaaatctttaatgaatttatccaaaagaggattgccaattgcttcagccatgatcggtagactggtgatgatcagctgcacgtttttcttctttaggtaattgactgaagcaatgatttcgtcgtaatttcttccaagtcggtcgattgcttcgacaataaaaatatcttggtctcggacaaactctaaagcttcctggaaaatcggtccatgagtaatcgttgctccagattgtttctcgatgaaaattttttctgcgccgaactttttcatttcttcaatttggcgttgctcattttgatcaatcgacgaaactcgaatataagcaattttcaaaatttttacctacttcctcaaactatttaaaatacaccctaatcatacactttaaaactagatttttcaatgatatgtcagtgtctatttagggtacgctttaaatatcaatttgatttagaatgataaaagctaaatacctttttcatttgtcaaattaagttagacaaatgaaaataataaaagaaatgaggtaatgaattgaacgaagtttcaaaggacgttctggcaatcgaagcccacgaaaaagcaaagtcttagtctgatacgcttaacacttctttactatagattgctctaagtgtaaaccgtcaggcttttttactgtctaaatttaactagcaccacgcgtatgagtattagtctcttaaattaaaattggtctggaaagtaacttgttaattcaagttctttatcaagggctattaaatagggaaccttgtagggaaatcaattcattttatgaaagtgatttctcatttgtttaaacaaaattatcctaattatttctaatagattctataagcaccttacttagcgatacataaaaattgtgatacaattcagttatagttttaaaggatattatggtcactaagttacacatataaatttttatggaggtgttgtaatatggcaaatttttacggaaatgatccttttttcaacaatgatatggatgatgttttcaatcaattatttcggcgcatgaataatcaaaattcggagcgtgcacggtatttagttaatggacaatcgttgacaccggatgagtttgctcaatatcgagcaactggtaagctaccccaaaataataaaacaatagaagtatctaaagatggtaaacaggctgttaaaaaaggagggattttagaaaagttagggactaatttgacggaacaggctcgtgatggattactagatccagtgattggacgtgagaaagagattcaagaaactgcagaaattttgagtcgtagaacgaaaaataatgcaatcttagttggtgatgccggtgtaggtaaaactgcagtcgtcgaaggtctggcacaggcaattgtggctggtaaagttccagaaacgattcaagataaagaaatctattcgattgatttatcgtctttggaagcgggaactcaatatcgcggttcttttgaagaaaatattaaacagctggtagaggaagttaaagcagctggtaatattattctattcttcgatgaaattcatcagattctcggcacgggtgccactggtggtgaagatggtggcaaaggattggctgatatcattaaacctgctttgtcacgtggcgagctgagtgtaatcggggctacgactcaagatgaatatcgcaatactattttgaaaaatgcggctttggcacggcgattcaatgatgttgtgattaatgaaccgactgccgctgacactttacgtatattacaaggtgttaaagagctgtacgaaaaacatcatcatgttgtattaccagatgatgttttgaaggcggctgtggattattcaatccaatatataccacaacgcactttgccagataaagctatcgatttgatcgacatgactgcggctcatttagcgtctaaaaattcgcaaactgatgttgagacattggatcaacgccttaaaaaattagaggcagctaaggaggccgccattaaagcggaggactttacaaaagccgctgatatcaagaagtcgatcgaggaaaccaagcaaaaaattaaagaaacggatcaaaaagaaaaaatcactgccacgattgatgatgtggcacaatcggttgaacgtttaactggtataccagtttctgatatgggcgctaatgatattgagcgcttgaaaaatcttgataagcgtctgaaaagtaaggtaatcggtcaagatgaagcggttgaaatggtagcaagagcaattcggcgtaaccgtgcgggcttttcagagggtgatcagccgattggaagttttctgtttgtgggcccaactggcgtaggaaagactgaattagctaagcaattagccttagatatgtttggaaatgaaaatgcgattattcggctagatatgagtgaatatgctgatcgtacagctgtgtcgaaattaattggtacctcggctggatacgtaggctatgaagataatgctaatactctaactgaacgggttcggcgtaatccatattccattgtattattagatgaaattgaaaaggctcatccacaagtattaacgttactgttacaagtgatggatgatgggcgcttaacggatggacaaggcaatgtcattaatttcaaaaatacgattattattgctacttctaatgctggctttggtaatgaagcattaagtggtgacaagcaacgagatcagtcattaatggataagttagcaccatttttccgcccagaatttctgaaccgttttaatggaatcgtggaattttcacatctgactaagcaagacttaagtcaaattgtcgatttgatgttggcggatgtacaaaaaactttagccaaaaaatccatcaaacttgaggtaactaaagcggctaaagattggctgatggaacaaggctatgatgaagcaatgggtgcgcggccattacggcgagtaattgaacgacaaattcgtgataaggtaacggatttctaccttgaccacttagatgtcaaaaacttgaaggctgatttagtggatgatgggattgtgatatcggcagcttagcttaaatcagtgttcataaataactttatataagaggagatttattgggaaggagattgcttgatagatctccttttttcgttgattttcaccatttgatattaatctattgagtaatatgggtagcgtcaagaatcttgtgtaaatgaaatgcctccgtacatataatatgtagttaatttaaataaaggatgattccagggtgtcctgaagtcctttgaatccgcgatggattcgcttcatagacttctcgttgtagacattaaactgagaaaccaggaatcgatccagtgaatcttccgttggaaattgttctttgtggttgatgttgcgtttgagatgtttgttaaagttctcaatgaagttggttgaatacaatgaaccgcgaatagctggtgggaaatccatgaaagtgagcagattcggcattttaagcagatttttgattaacttgggataggtctgatgccagttgttggcgaagtcattcaattttcgtacctggcatgacatttagtgggacttctgaacgaaatgaagttgattactgatgaatataactaggaaatgacgcaatcgattggggatatggaccttgaagatgccaaaattagcatagaagatctaagtgtttatacgaacgatgatcaaacctatttcgtcgtttttgatctcaaatatgaaggattggattcaaatcaagtccttgtttatgtagcatccgatcacgttagttattccaatataatcgatcattatgagctaatcgcaacaaataccaaattaaaaaagtggaatagatgatggctattttcgaaaaagtctcttactttatttctatcgatcatcggtaaagtatcgtcggtcggtcacaaatcaagtcaaacacctggaacgggtgacgagcaatgaatttgatcaattcaaaaataaagtagcttttgaaaagctgcagcgtgaaatcgaacaagcaaaaatgattcaagagtcagacctattcaattaggagaaagaggaaagtcatggaaaattattactttatcaatagcgtggatccagagaaccaaatgatgcgtattcaagaagtgggtgctggcgaaatgagtgcgcaacaggtacgtatcacgaaagaggatgccgatgtttattctttaatgttggatgaagcaacgcaagaaggggagccgctgatcgttcagctggatctaaaataaagtcaaaatcagccgtagaaaaaattttttcgaccagtacaaataaaaaccgattttctttttttagaaagtcggcttttaataacgaagctaatttagttgaagtagttgctcaataatcgaagagctgcctggtaaaaataaaagtagactacctatgactaacaagatccctaaaacaaaacaggctattacgaatttggttgatctagatacttctttatttgaaacacttatgatcaacaaagttataccgacagctaacgttaaaaaataccaaaatcccattgttatcgcccactttctttgaatagtttttactttcaaactgtttaataaattttatcatagacaagaagaactaatccttgtacaagaaaaatatatgtaaagtttaaactttcttatactatataggttgaattaaatactttacatccgcacgcacagtcggtcaatcactaccaagccaggtaaaagcaaaggggctatttttgcgtatcgctcaaaatcaagcatgattggcggacgtggcgttgttctgacttccgaagaagcgattcacgaaaacaaagatacatttacgcattggacacccaacgtttatcgttatggaacatatgcagacgaaaatcgctcatatactaaagggcattctgaaaataatttaagacaaatcaatacattctttattgattttgatattcacacggcaaaagaaactatttcagcaagtgatattttaacaacagctattgatttaggttttatgcctactatgattatcaaatctgataaaggttatcaagcatattttgttttagaaactccagtctatgtgacttcaaaatcagaatttaaatctgtcaaagcagccaaaataatctcgcaaaatatccgagaatattttggaaagtctttgccagttgatctaacgtgcaatcattttgggactgctcgcataccaagaacggacaatgtagaattttttgatcccaattaccgttattctttcaaagaatggcaagattggtctttcaaacaaacagataataagggctttactcgttcaagtctaacgtttttaagcggtacaaaaggcaaaaaacaagtagatgaaccctagtttaatctcttattgcacgaaacgaaatttttaggagaaaagggtttagtagggcgcaatagcgttatgtttaccctctctttagcctactttagttcaggctattcgatcgaaacgtgcgaatataatatgtttgagtttaataatcgattagatcaacctttagaagaaaaagaagtaatcaaaattgttagaagtgcctatccagaaaactatcaaggggctaatagggaatacattaccattctttgcaaagcttgggtatcaagtgatttaaccagtaaagatttatttgtccgtcaagggtggtttaaattcaagaaaaaaagaagcgaacgtcaacgtgttcatttgtcagaatggaaagaagatttaatggcttatattagcgaaaaaagcgatgtatacaagccttatttagcgacgaccaaaaaagagattagagaagcgctaggcattcctgagcggacattagataaattgctgaaggtactgaaagcgaaccaggaaattttctttaagattaaatcaggaagaaatggtggtattcaacttgctagtgttaaatcattgttgctatcgatcattaaagtaaaaaaagaagaaaaagaaagctatataaaggcgctgacaaattcttttgacttagagcatacattcattcaagagactttaaacaagctagcagaacgccccaaaacggacacacaactcgatttgtttagctacgatacaggctgaaaataaaacccgcactatgccattacatttatatctatgatacgtgtttgaaagagaagacgaaaacggagataaaaaatattatatcggtacatttcaaagcgataagttgaaacgactcactccatataaagatgataaagaggaattggctcaacagcttaaaaaacagcaagaccaacatagagaacaaaagcaagaacaaacaatagctttacaaagagaagaagaaaaataaaggagaatgagctatgaattttctacaaaataatttccaaactttatatttaggtgcagctgcaggagatattcaaggaagaatttccggagcattaacaacagttcaatccgtattgacaggtatacaagatcgtcaaaaagcatttagatgaagcggaaacaatcgtgattgcgaccgacagcgaccgagaaggtgaagcaatcgcccgcttgattatcaacctttcgggaaatagccggaaaaccattaaacgtttatggatcaactcgcttgaaactagcgaaatcaaaaaaggatttcaaaatctgaaggacggacaggcgttttattccacttacaaagaagcagaaacccgacaaatcgctgattggctggtaggaatcaatctcacccgtctttacacgctttatatgcagaaaaacggcatgagaggcgtgtttagcgttggacgcgtccaaaccccgactttgttcttgatttaccaacgcaacgaagaaatcaaacatttcgtcagcaagctattttatgagttgtatgccactttcacacactcgaatggtaagtacaaagggaaatacaaagagcggtttgatacactcgaaaaccttgacgggttcaaagaaaccaatcagctagagcaagcggagaatgccgaagtaacaaatgtcaaagtggaagaaaaacggcagtatgcgccgaaactctttagcttgtctgatttacaatctttcgcgaacaaacgctttaagtacagtgccgacaaaacgctttcgatcgctcaaaacctctatgaaaaaaaggtgctttcttatccaagaagcgataccaattatattggtagccccgaatttgactacctgaaaagcaacctcagtcggtatctcgaactagcaggagtgggcatttccgaaccgcagctaaacgaaaataaacggtatgtagatggaagcaaagtacaagaacactatgcgattattccaacgaagacattgccgaagctcagtgatgtaacgaaagacgaaaaaaacatttatcttctggtcttgtatcgtaccctcgcaatttttgaaaagccgtatatctatgacgaaaccaccattgatacagcgatcaatcaggttctgttccaatcaaaagggaagacagaaaaagagcgtggatggaaacgactatataaacaggaagaaaaagacaaggacgacccacttttaccagaagtaaccgtcaatgattcagtggctttcgcccttgaaacaaaggaagggaaaacccaaccacccaattactatacagagggcacactgctaaccgccatgaaacatgtcggacgggcaatggacgataaagacagcaaagacattcttaaagaaaccgaagggattggaaccgaggccactagagccagtatcattgaaacattgaagaaacaggactacatcccgatcagtaagagtaaaatctatgtgacagaaaaaggcgaattgttgtgccgcataattgcagaggacgaaatcgccaatgccggcatgactgcccaatgggaacgctatttgaaaaagatccgaagccaacaaggcacacaagaagcttttttaggcagtatcgagcggtttgtgcagcacctcattgaaaagtgccacaaaacttccaagacaaaaaagaaaacattgcagatgtagccggtcatatggaacaagaaaatgtgatgggtacgtgtccgaaatgtcaaaacagcgtagtagacaaaggaaaattttatggctgttcgggctacaaagacggttgcaaatttacgcttcctaaaagatggagccaaaaagcactcacaaagaaaaatgtccaagatttattaagcaaaagagaaacgagtttaatcaaagggttcaaaagtaaaaaaggaagcaatttctcggcaaagttaacactgaatgacgaaatgaaattagcttttgaatttccaaaaaaataaaaacacaagatctagaccttgccccttttggaaaaaaggggcaagcccccaaaatcgtctcagtcacccagttgtaatagcctaaaactgaataacacttaaataagtcaaggaacgggtaagtattttttggcagaccaccaaaaaatctccaccctcacagtccttgacttctttatttttggctgtgggctgtcgtcgccgacagtcaaaccagttgtaaaaaatatttgctatcttgcctgtcgctaaaatagtgtaccgccaaaaaacgcttgaaaggaatttttcttttgctcgcttgttgctttgtaagaataagtagctattctgcaaataaccctaatatttcgtatttctctaaaaaaccagtgtttgagagggaagttctacgctcatttcagattgatctatgggtaacttatccatgaaaatgcctgtaaaccgctcttttttcagtttttttaaagagagagaaaataaaaataaaataccaactttttacgtatattaataacgaaggacttaaatataggatgatcaaaggaggcgttcttatgtatgaagacgaatggagagaatactatgcaaccaaaaatgagagcatacatattacgagaaacaaactcattttccaatgcaatgaaggaatcgctctgtctactcataaaacggaaattgaaagaatcatgcatgcattggcacttaaactcttattactggagttaaattcatatgatttttaatctgcaaaaaagtttatagcaccgtcgcttataccagaaaatataacaaacgccgcattgtttttttgtgcactttaataatctattcaactaaggaattaagctggctgtcaagagagtaatatcgtattgaatctcaggtggaaattttctgcggtatcttttttgactgaaatgacattagtgtcttttggggattgtgtatgtaagtatttttaaaatcattttaacaagttttggacaaaaattctcatgaaaaaacagaatttaaatagcatgataaattagagaagatagtttaatgtgcttataggaacaccccacttttacagtcacaatcaatagccttgctactttctttcgaaattgataagagtctaaaggattgacaacgcttgatagtgagcataaacttagtgtacgctagttaatttacaagtgtaaactaaaaaagtataatgtgtcgtctctgaaattctccctgattcaagtcataaccagagtacatatcggttattttttgattccatattttttcctttaggtgctgaggattaaggggtaccaattgtaattgcgcgttatatggtctttgtttagaatcgctctccaaaaagccaatttttttgcatagaatttttagatgtggtaccattaattagaattattataaataagaagtagggtatcattgtttcagtacaaagactaggaggaatggaagatggaaatagactacaaggatcatgggaagaagccgtatatcattaatattgaagacgccaccacaggaaatgataattaccggacgaccatttggacaggcagtaaactgcaagtcaccgtaatgtccattcaaccgggcgatgacatcggtttggaagtgcacgaaggcattgaccaatttatccgtattgaagaaggagaaggcgtgtgtaaaatggggccttctaaagataacttacatgttcaacaaaaagtgatggatgatgacgccgtatttgttccggcggacatgtggcacaacatcgaaaacaccggtgataagccgctcagactgtataccatttatgctggtccagatcaccttgaaggaacggttcaccctactcatgaagacgccaaaaacgatccaaacgaacactgaggtacactaggatgaaacaaaagccctgcacccctatggatggtccactggtgcaggccttttttataaaggagagaagtggtatgagtgattcattgtttcaattagagaaggttggttttcaggcaaacggaaaccaaatccttcaagatatctcttttacagtaaacaaaggggaagtgattgtttttactggtccttctggaagtggaaaaagtacccttttgaaattaattggtacgctgctttccccaacttccggaaaaatttattatcgaggtacggatctgcaaaaaatcgatcctgtggagtatagaaaagaagtctcttatttctttcaaaacgcttctctattcgatgagacagttcaagagaacttgtcttttcctgcccgcataagagaagaaggatttgatcgggaacgtgcaaaaaaattgttagaacgagttcaaatacctgaaacttacttatcgaaagaggtcaaggagctatcaggaggggaaaaacaacgggttgcattggtccgaaatttgatgtatcaaccgaaagtgttgctcctggatgaagttaccagttcattggaccaagaaaacagagcgattgtccttgatttagtccgagacatgatgaaagaccaacaaactacggtgttggccgtcactcacaaccaggaagaaatcgaccaagcttctcgtctgattactatcaaaggtggaaaaatggaggaatcgaaatgacaaacaatttggaaatcagtaatctttctttgcttttatcctctgtcctcttgatagttgccttgttgattgattacaaagagaaattgggattaggaaacgacatttttattgcgggaattcgcgctgtcgttcaattattccttattggatatgtattgagctacgtattacgagtggataacaactttctcactttagcgatggttttgttcattgtgttcaacgcttcttataacgcccatacacgcagtgaggggatcaaccgctcttttaaaatttcaacgacggctattggagtaggaacagccttgtccttactcattcttgttttttcaggagtcattgactggtccccttcccaaatcgttccaattacaggtatgattgccagcaacgccatgactgcgattggagtgacctatcggtctttgaattcaaaatttacggaccaacgccaacaggtattggaaaaattggcattgggagccaataaaaaacaagcgtccatgagtattgtaagagaaagcgtcaaaacgggcatggctccttcaattgaccaaacaaaaacggttggacttgtcagcctgccaggtatgatgtcagggttggtttttgcgggaattgatcctgttcaagcgattcgttaccaaattgttgtgatgtttatgttgatttcagttactgcgatttcttcgtttattgctagttatatggcttaccgtgagttttataacaatcgcagtcaattaattatatgatttgggatgatacactactcttaaaaccagtggttacaattttatgtagttaaaagaagacctcacgagaataattgcaaaaagaacttcattttttaaggaagaaggatatttttgtcatcgaatctttggaacgactagggcgaaactatgatgaaattttttatatagtgcagcaactggattaaaaggatatcggactgattgttttgaacatgcctatcctcaaccaatgagaactttcgacgaaatcatgttctagaaagaaatttctatccaataagaattccaggttctgttgcaaagttttaaataaagaataaaatcccttacggtatctatgattacggaaagaagttctgcaccttataaaatttgtcaaaaaaactgttgccattccatctacataaaataggtgaaattctattgttttttcttttcgaacataaatcgagttaacaacattggtttttaacatttcaagatgatctttatagattttggaaatagggacctcatttacatctaccatttcttttaatgtagttaatggtttttttctttttttcacgcagtgtattttttctttatatttttcaaaaagaaaatccgtatctaacaatattccttttcaaataagtatatggatctggtcaatataacttacataaggattgttaaatagtagtttggcaataatcgttttttagtaacgtagcaaatattccctaaaaattaatagctgtttgctatggtggtaataaactcaaagatctataacacaggatcattcaatttgtaatgattatatttcgaaaaggcttctatcttatcgaaaatgctatctacgtcagctgttgctaaatcctgataaaggatggaaagcccattttttttgatctcatcattcatataagcttgatccatttcattgtacataatcaaatcagcttggggaatatcagtagtaatatcgtagctaatgattgaaaggtcccattcgggttcaacttttatacgtaattgttcctgaagcttctttgatctactccagatcataccggctccgctactcttaagaattccccctcttgtgtttaccgaataaatccataccagctttttcatacctttcactccttaatacttttattgtgtctatataatataagtaatgtagtatatactttaatactcttgaacttgatagttatcttcagttagcagagaagatcattatctgttcatttaacctaatcatagaccactcttggaaataatcaagttgttcgtataccagtatactttttcaacatactgagttgagtactgactagctataaatcactaattctataatttcattaacaatagtagctttagggagcttaagacgtatctcttgaagtttcttgcgaataaattttttataaactgtgaggggagctaacaaaatggctaaacacacgacacttttccttgtttacggtgtttgcataagatttgcataagaggagaaaaattgttatgtagcaaaaaaagcaggtccttatcagtagcgctttgacttaaggtgtagccaagaatcaggaaaaggattggctaaaaaagtatgatcaccagaagttttggatgaatgaaatgccgtacctctcatcttgagactgttagaagaaagaaaaaaaaagaaggggcactagaaacaactgtatttcgtgaatggatcgtaaaagaataagaaatattgtttttacaaaaacctgaccgaaaaacagtacacattttcgtattttttcgttttttcttgactactgatggcgctatcagtatcataaatggcagatagacacagccaaataaaaaaaggcacctctgcttctagtggcagctagaagtagagaccttgaaaagtcatcacacgtgaccgtccaagtttgccatagtcaatgtaaatacatcaaccttgtttattgtatcgaatctaaaaggagaaatctaccctttagaggagaaatttcaacaaaatgtatgcgttttatttgctgagcaaaaggtattggacgtttgtgttcaataccttttttgtctgaacatacacctgaagataaaactgctctgttcgaagatctcttgtgcttttaatagagctatagccagcagaatcggtcagtgtaaaaagatgttttttcgtcaaaggaactagcctttgcgtatcttattatggaagcagattttatttggctgttttctatcgctgaaaggagaggagcaaccgatgcaagtgatcgctattttgaatcacaatgctatcattgcgaaatcagaggaaggggagtgggtgttgatcaaaaaaggaataggctttggacgcaagatcggggatccaatcaatgaaagagatgtggaaagtgtctatcaaaaaatttaaaaatcggggagtcactgttcaacaggcttgacccatttcgcttcagcggaatgcgtcaagcctgtttttttgaagggaggaaataccgctggaattgactcaagtcatttatgaagagttgctgatcattcagtcaaaagcacaaacgaaacgccaaatcttaaaagaattaacaaaactcatgacagataaaggcgtaataactgatacagaaagtttcttggatgatgtctatcaaagagaagcagaaggagcaacaggaatcggacaaggaattgctatccctcatggtaaatcaccaagtgtccggcagacagtgatcgcagctgctactttagctgatccgattccatgggaaacattagatgatcgtcctgtagaaatcgtgattttatttgctgtacaagaaggtgacaaaaataaagggcatcttcagcttttgcaaaagattgccgtacttttggcaagagagaggtttatcaaagaactgaaaaaagctgcttcaatcgaggaattatatatattattgacacaaaatgactaggaggaataatgacttatgttagtaacaggaaaagaaatactagccgtagcgaaagagagaagctttgccgttcctgcctttaatgcaggttctgggcaattattgaacgcagtgatagaagcttgtgaagaagcagaatctcctgttatgattgcaatccatccagaagaactgaaatttttggcagacagtttcatcgctcaagtgaaatatgcagctgagcagacagatattcccgtatgtatccatttagaccatggtgatgaattcaaacaaattattcatgccatccgcttaggttttacttctgttatgatcgatgcatcccatcaatcgtatgaaacaaatgtcatgttatctaaaaaaatagtagaagcagctcacgctgttggtatttctgtagaggccgaactggggacgatcggagacacaggtaatactgtagaaggcggtgtcagcgagattatttatacggatccgttaacagcacaagcattcattgaggagaccggaatcgacagtttagcgatcgctattggaacagcccacgggatctatcctaaagaactcaaacccaagcttcgcttcgatattttagaatcgattcgatcattgactactattcctttagtccttcatggaggatcaagcaacccagatgaggagattcgtcaggcagtagaattaggaataaataaaatcaatatttccagtgatatcaaaatggcattcgcagaaaaactccgagatatcttgaactcaggagatttagagatacgtgaaccgaatatactgtttccaccttgtatggaagctgcaaaacaggttgctttagataaaatttatttattccaatcagatggcaaagcaaaatactatatgtgagggggcaacaaaatgaagatcgtaggaatcgcagcttgtaccgcggggattgcacacacgtatatcgcaaaggaaaaactgcttcaagcagcagagagccttggacatgaaatctggattgagacacaaggtcttgctggaacacaagagccactagagcaaaagtgcattgctgctgcagatgtcgtgcttattgcagcagatatcaaggtaaacggaaaagagcgttttcgtggaaaaaaagtagtcgaagtaccaactagtttagttgtcaaatctccgagaaagctgatcgaaaaattagaagagatgctgaatgaaagaatggaaggggaataagatggagatactgaaatcaataggcttcaaaaaacatttaatgacggcgatctctttctttttacctatcgtcgtcgcttccggattcttgctagctattgggaatatgatggatggagtcactattgaatcattcacagatgggttttcttttgcagatacgatgacaacgatgggaggatatggtttaggtttattaccaatgattgtttcctgtgccatttcttattcaatagcagataagcctggtattgcccctggtttgattactgggatgaccgctagtgggattggagcgggatttttaggtggaatggttggcggatatttatctggattagttgttattggactaacggcaggaatcaaagtacctaaatggatggatggtctaatgccgactctggttttaccatttctcagttctttcattggaggattggtcatgtattacgtgatagggacacctattaattggattacagagatggttacaggttatctaagtaatttagatacttcttcgttatttttatatggtgcagtaattggagtattatcatcaatcgattacggtggagcaatcaacaaagtagtatttgcttttgtgtttgctttgttttcagaaggaatctatgaaccaatcactgtattgattttagcttcgatggtaacccctttcggcttgtcgatcgcttatttcttagggaaaatcattcgtaaaaatatattcaatcgtcaagaaatcgatacattgaagaccgcttttcctatggggatctgtcagatcacagagggatgtttccctatcgtattgaacgacttggcacgcaatgtcatagcaacgggagtcggtggggcagtaggtggcggattaagcatgctttggggcgcagatagccgtattccggcatcgggaatgtttgcagtcgctacgatgaccagaccatgggcattcattggtgcattgttagctggttcttttgtcacaggaataaccattttattattgaaaaaaccagtagatccgaatgcagaaatcatccaagaagaaaaagaggaagaagacatatcttgggatgatttgacaattagttaggagaggcagaatggattacaagaaaaaagtacaatagatgtaccttgaggcaggaatggtatgaaagaatcagagttagaaagaatcgaatatacagattttggtttaggagcgatcgaaactgtccagagcatcggcaccctccttgaaatgacgatgaaggaaaaatgagaacctttcgttgtcgaaaaggtctggtataccttatgtcgaaggaaaggaaacaaaaaaactttcctgtactattccaaaaaggaaagaaagttattatacagtaaaaaaagaaattattcttcatgctagagatcagtacacgatcgagcccaatatcaaacactagttccaggcaggcgcaacaggtgcggttatcactgaattttcttccagcagtgacgattcaagtgatatttttacaaatccagctatttatcgttaacaaaaagatttttaggagaagctgatgaacaaaaatgatcaaattttgatcgtttagttcgtcggcttttttatttagagaaacatcatttatcagtgaaacataacacgagaacaaaatgattttttcgttaataaaagaaacaagtatttgttgtttaaaataatacacgttattggcatataggacgaaatcccagtatcttctataagtaagtcatttcatatcgatgaaaacacgttatttatttttgttttatctataaaatagctgaaaaatgattttttcctaaatactatatatagtggtgtctatcctatataccactaaaaaactacaaaatctagtcttttattttaaaaaaacacgtgtagaatgaagatagacttttgagttagggagtgtttttttatgaaacttactgttttttgcggttcccgttttggtaataaagaaagttacaaatttattgcgcaaacgttaggaaaatacatggcacaagaagaaatcgaactggtttacggtggttcatactccgggattatgggagtgattagtaaaacagtactggaaaataacggaaaagtcacaggtatctatccgaatgggctttttgaaactgaattgcctggaaaagatgttactacatttattcctacagaaacgatcgatgaaagaaaggtattattatttgaaaagggagatgctgtcctcgttttccctggaggtctaggtacattggaggaattctcacaacttctttcttggatagcaatcggtctgacgcctgacaagccaatcggaatattgaatattggcggttattacagcggcttgcaacaattattagaaacttttgcaaaagaggattttatggataaaaaatggttggatcaagtaatcttttccaacaatccattggaactggtcaatgaattacgagcagtatctattaaaaatcagttattattgaaggaggcaaaataatgagtcaaatatatttagcaggaccatttttttcagaggagcaaatcgatcgagtaagtcgtatcgaaaaagcgttggaggaaaacaaaacagtcacaagtttctactctccacgtcatcaccaagaaagcaattatgaactattcagcgctggatgggcgcaggaagtatacgaaaaagatatggaagaactgacaaatgcagaatttgttgttgctatccttgactttgagcatcaaacaatcgatccaggaacggcttacgaattaggtgtggcaactatgttgaaaaaaccgatgatcattgtacaagaagagacggtacctacaaacttgatgattacacaaagtctccatacgtatttaaaatcagaccaagctgtacgtgaatatgattttgaaacattgcctgttgaaacttacgtaggcgagtacttatagaagaggaagggttgtatgtcagtgattttgatttcaggaacgattggtgcaggtaagagcagtttgacggatatgcttgcaaaagagattgattctaaaccattttatgaaaatgtcgaagataacgaagtattgccgctcttttattcaaatcctgagcagtacgcatttttattgcaaatcttctttttgaacaagcgatttttagcaatgaaaaatgctttagtgaacgatgacaatgtgctagaccgatccatctatgaagatagcctgttgttccatctaaacgctgatttaggtcgggtaacggatatcgaagtacagcagtacgatagcttattagatacgatgctaaacgagttagatgatgttgctccaaaaaaacggcctgatttgatggtccatatcaaagtttctttggacacgatgctagaacgtatcaaaaaacgtgggcgtgattatgaacagctagaaagcgatgaaacgttatatacctattacgaaacgttgaacacccgctataatcaatggtatgaagattttgatgtatgtcctaaaatacaagtggatggggatacattcgattttgtagaaaatccagaagatgcaaaaaaggtgatccgtcagatccaagaaaaattagctgaattggaaggaaagcctgctggaaaatattttacggataaccagcatgcaaaaggtcaagaattaggctaaaaataaaaaaccaaacgacgggaaagaaaaattactacgtgatgtagaataagcctttctgtcgtttggttattttatattcaaatatttgaaataaataaatctttactctttgatttgtaaactgaaatgatccactgtttgttttactgatgaagcttgatcaaaggaagaagctgagtttgaagttcataaaaatcagccatagtgagttttgcttgattttgtttatcttcttctactttttacataattttgaacaggataagattcaaatgttttaaatgaatctttgactagtttgtgacagttgtcgcatatgctcaagcttccttggtcattaaattctgtatggatatttttgttgttattacatgtacaataatcaggactatcgatcatccatttcgtctcctttacaatcatcttgcttctttactatagcagaaaagaaggggagaaacaaaagaagatccaacagacggcactatagactgtagatgttgccatcctcatccttcaaacggtaattaccgatttttgtaaatatgactgttgtttcttttttattttcttttcctgaaataatatattcgtcatctttggtagtgatcttgatatctgtcagcactgttttttcttcagatgattcagaagaatcagttccttgtgtctgatacgtgcgtgtccattccatttttttatctgtaaatgtcaactgtcccgcggataaatccatatctttacgtacttttagcgtatatacactgttagtgatatctgctttttccgcttttaagacagaagaatcggttgtttcatccgaggattggtcagagccgccaaacaaattacagccagtcaatgtcaaaagtcccgcagacaaaataaatagtacgattaatttcttcaaaatacttcccccatttgataggataaagaaattataccattggaaagtaaaacttcaaacggatggaagagaaaaacgcacaaaacacccacaaatagagtaaattttagaataaaattttaaaaaggcaaaaaatccgccactttcagaaagcgttttaaaaaagtgttgcaatcttttaaaaaaatgctatattaaaaatgaaccggttcaaatacttgtttaagtataattaatagtgagaggaagttgctctactgaagactttagttatatggatattgatgacaagcaacactatgcaaagaaagcggtcatcataatcgaacaacaagaaagagaaatcaaatgtaactggcaggagtgagaatgtatggcatcgatccgtgacgtggctaagatggctggtgtttcagtgggaacagtttcccgttacttgaatggtcagcaactgaaggaaaagaacatgaaaaaaatagcagaagcgatttcagcgttggactataaagaaaacatcattgctaaagggttgaagaataatcgaagcttctctattggacttttgataaacgggatttccagccgttttgggtcggaagttgtctcagggatcgaaagagtagctgaagaaaatgggtatagcttattattaagcgggtttgccgatcagccagaaaaaattgaacaaaaaattgaatacctgatgaagcatgtgatcgatgggctgattgtcttcttatccgaagaagagtggtctggatttgaaatgctcacaaaaatgagtattccagttatcgcattgaattgtccagaagggccagcaggtattgatacaatattagtgaatgatcgagaaagtgtagcaaaagtgatcgctcatcatggtgaacaaggacataaaaaaatcggatttattgctgccactcaaacagactacgtagcaagagaacgtttagcaggagccaaagaagcggtacaaaatgatccatcgatccaattagaggtctttacaggagactattctagaaaaagtggctattatggggcaaaagaattattagaaaaaggagtaacagcgatttttgtcagcaattataatatgtcgatcggtgctatcgaatgtttcaatcaagaaggtatcagaatcgggaaggacattgcgtttagtcattatgattatttggataaaaacgaattgagcatccttccgaaaatcacgattacaccaccaacagataaaattggggaacaagccgcagaacagctgttgaaacgaatcaaaaaagaagaggaagaaaatgaaaaagtgattgtgatggaaaatatcatacatggaatcaactaaaacgaactaaaaaagaaaaagaggtgctttgatgaaaaaatatcaatttccagcaaatttttggtggggttctgcagcaagtggcccacaaacagaaggaaggatttcaggtgatggaaaaggagagaacatttttgattattggtacaaaaaagaaccgcaaaagttctttgaccaagtaggacctgaaaaaacttcacaagtttatacgaagtatcaagaggatgtacagttgatgaaacagactgggcataattcatttcgaacatctatccaatggagccgtttgatacctgatgaatctggaacaatcaacgaagaagccgttcgtttctatcatcgttattttgatgagttgattgaaaacggtatcgaaccctttgtgaatctgtatcatttcgatatgccggtgtatctgcaagaaaaaggcggatggttgaaccgagaaacggttgaagcctatgaaaaatatgccaaaagttgttttgaattgtttggttcgaaagtaaaaaaatggtttactcataatgaaccaatcgttccagtcgaagcaggttatttatatcgatggcattatccagaagagtcagatatgaaaaaagcgatccaagttggctatcatgaagcgttggcttcagcgttagccatcaaatcttaccatgaaatggagcaaggtggtgttattggtatcatcttgaatctgacaccaagctatccaagagacgaatcaaaccctgaagatgttaaagcagcgcaaatagcagatgcgttcttcaatcgttcattccttgatccagctgtaaaaggcgagtttccaagtgaattgattgagatagtaaaagaacttgatctcatgcctgtgatccatgcagaggatttgacggttatcaaagaaaatacagtagatcttttaggtatcaattattaccagccacgccgggtaaaagcaaaagaaacaccaatcgatactaaaaacggtccaatgcctgaggattatttcgacaattatgaaatgcctggtcgtaaaatgaatccttatcgcggatgggagatctatgaacaaggaatctatgatattttgatcaatgtacgagatcattatggaaatatcgactgctttatttctgaaaacggtatgggtgtagaaaacgaagcacgatttatcaaagaagatggcatgatccacgatgattatcggatcgaatttgtccaatctcatctgaaatatgtccatcaagccattcaagaaggtgccaattgtttaggctatcatatgtggacatgtatggataactggtcgtggaccaatgcatataagaatcgatatggctttatttcagtagacttagcacaagatggaaaaagaacaatcaaaaaatcgggtcattggttcaaagacgtatcagataaaaacggatttgaggcttaagaaagaatagttgagagcaaatgcgtgaaattctccattcttaccattttgtgaaaaagaagttcaattatttacgatctttttcaacttttttgtctttctatttcattttttgtatataatagaatagtcaaaattaaataggagtggaggaaagcatgaggaaaaaaagaccgtttcttctcttttggttattcggttttttcttactgcttattttatccgcagcattttcaggaaaaatgacagcagatcttgctcagaaagaaacagaaaaaatcgtagcaagcaaagaatcagtagataatttcaaaaaagaattctcaacttattggtgggcggagtataaaataactgccaattacgaaaaaggcgaattggacatttatttgccaaaaggaaaagaagaaaatcaatttattaatatcgatgacgtacttagtgcgatttctctcagacaatatcaattcaaagacaaacatttgaccgttttgcttttgactcatgatggcgacaaagtagcccgtttgaaaaatggaaaagtgatcaccgcttattctgaaaaagtagacaaaaaagtggtcgccgatcgtttagcggaatggaaaaagacaaatgaacaagtcaagaaaacaactatctcttctcaaaaaaacgaatcgacaggaacaagcccttcagattctggcagtgggcaaacgataacgggaaatgaagaaaatcaagcctcaatcattacgaatgagtcatcagaaggacaatatcaaacttatgggcaatgaaaaacagaggttgtgaaatcagcgttttgacctgagtattagagaaacaaacggcaaaatagttcctcatattttgccgttttttgagctaataccgaaggtcagctgattgaacaccgtttaagaaagaggttgtgaacctgccgtttcagtctgagtcacaaggagcaatttcaaaaaatagctccttatatttttcgtttggttgggcttattaccgcagatgcaagcttttgaacaccgtttaccaagaggtcttgagcctgccgtttaactctgagccacaaggaacaatttcaaaaaacagcttctcatgttttataaatattgtgacttgtggccgaggagttggcaggagaacaccgtttaaagaagaagttgtgaaaaagctgtcctgcatcaagaaataaggagctgcgacaagaattttgtcacagcctctttcctacgattagtcaagtaaaaggtgtaagaaaaatagctcataaacgaaagcgacaaaatcaaggcacaccaaataaagcctcgttcgtaaaaaattttcgatctgggcaaatcatagataccgtaagggattttattctttatttaaaactttgcaacagaaccttaatacaatcaaaaacctaaccgaaaatttaataacgtttcactgatttcatcttcattaattccgatgtagcgtttggtaatcttctcgctgctgtgaccaaagatttccattaaggtggccacgtctttggttttcttgtaatagtggtaaccaaaggtttttcgtagggtgtgggtgccgatatcgtcccttcctaacagcttcgcgaccttttgaaacatctggtagactgtattgatttctaaatggccgtccttagtagtgggaaacaagtaagcctccggatctaagggtgcggtatagccgtgaatcaagtcctgtaagctgcttaagtataaaatgcgtgttttccctgtcttttgctccacgatgcgcgggttttttgaggtaatcacgtcttttttcttgagtttgacgatgtcggacatgcgcagaccgctgttaattccaattagaaacaagaaaacgtcacgttccgcatttttattccgtcgcaggcaaaataaaaaatcattaatctcctgttgcgaccgtagtggctgaacattatagcccatgacaatccctcctttttagtctgttcgaatacatgattacagttattataacacgaaatcgtgtgtttagggggggtaaaaaaaaagaaccctatagggataggattcttgatacatgattttatacaatttcatgtatcgcatgatactatttggataatgcgccaatctgttagcacaaaaaaagacatcgattaaatctcgttgtctttttttgtgctaacagtcaaactacttattaattaaataaacttaataaagtttgaatcgtaccattttcgatcaatatataaattcctaaaccaataaacactataggaacaatgattcgttcatatttttctaatgtttcggaaacaaaggaaatttttgctaatttataactgacatagcaaagaattgcaacagagaaagcaaatacgattaaagtaataacaatttctgaaaaggctaacgaagtaaagtaaggaatataaatgcctaaattatcgccacctgacgcaatggttattaaggcgacagtccaaaataaccaactggttcctctagattctaacttttcaacgacttcctcttcttcttcctcctcttcacctatcacagcgacacgaatacctaaataaattggaattaatccaagaagtccaatgatccaatcttgcggaataaaatttagcacataagcagcaaacaaacttacggctaccaaaatacctgttccaagatattgaccccaaaaaatgtgacgaatacctttttgtgtgtggctttgagaaaagataatgagcaagataaacaaataatcaatactggtagaaatataaacagcgatagctgaaaaaatactttgtaacaaaataacttcctccaaactaagatttcatagatagattttctgataacttaaaaaaaacacgaatagcggaaaggatgtcttcattcgctaaagagtaataaactacttttccatcttgacgtgattttgccattccatgtttttttaaaaaacgtaaatggtgtgacgttgtagcgacactagcagtaagtatttctgctaaatcacatacacacatttccttataggtttctaaagcatagaaaattttaattctagaagaatcgctgaaacatttccctaacacaagtaagtttgaaaaatctttttgatccaatttattttttattacatttactttttctttatgtacgatagtcacttggcaaactttttccattcatctcacctcacattcaaacgattgtttgaatgaagtatatctatttgatcactcgtttgtcaatctaccttaattccaatacactattataagcaatttcatgtatcaaaagattgttcaaataaagagcagcattgacaagcgtacttgtctgagttattctttattcagacaaataaacttgtcattataaaaggaggataattatgaaaaaagaaaagatattaaacagttaccgaaatgaaaaaaaagatgaaggcaacgaccatatcaataatatgagtgatgagaaaggtttctttgctatggctatgttaatcatgcttataactatctataaaatatatatgaatttgccgtttggagatactggtgcaatcccattatcttttttatcttttcatagctttaatcgttataagcaaacgaaagaaaaagataccttggtatatggtattgttactggttttattggaattgcgttcttagtttggtatgtgatcgaaacaatatgagtaaacaagataaaaattattcagaagagacagatttagtactgaaaaatcatttaaaggacacccgtagagaattagggctttctcaacaacaactcgcagatatgatcggtgtttctagaaatacgattggttcaatagagagatgtgtgtttgttcctacagcaaaattagcattgatattatgtatcgctttagataaaaaatttgaagagttgttctactttgattaaatataaaaaaattaaagaaccttgttaatacaaatttctagatacacgattctatgtaatttcatgtgttacaacttaataggaatttaaattttattattagattttttaatcatttacacgaaaattaattttataaagagcatactctatactcttattttttttcaagaactcaaaaaagcggaaaatcccagatttaaaaatctgagtttccgcttttgtcatttcaaggatggactattgtctcagcctcttctaatttattcttaagatatttttactttctctgcaggtgctgatacttctttttgttcttttcgacctttcaacttatacttcattaatctcatgccattgaaaattaccaccaagatactaccttcatgaaccaacattccgatagacatattcatccattcgctgaagaagacgctggtcaacaagaccaacactactccaattgaaatcacgatattttgtttcatattatttgcggtggcttttactaatcctaatgcgtgaggcaagttgctgaagttcgagttcattaaaacgacatcggatgtttcaatcgctacgtccgttccgcttcccattgcgattccaatgtctgctaaagctaaggacggactatcgttaacgccatctccaacaaaggctacaatttgaccacgttgttgaagttttccgatataagccgatttgtcttccggcaacatgtggccgtgagcttcggtcaaaccaagttcgccggcgaccacatcaacggttccttggttatctcctgaaagaacgactagatttttcacgcccaagtcttttaattcctgcaaattagctttcacacccggacggacttgatcgcgaatgcccatcagtacttttaattcaccgtcgaccgctgtcaaaacgagagagttcccttgttgttcaaaccgtttgacatctttttgcacttttttgctaagagtgacattttctttttccatcaaggccacattcccaacagccactctatgtccagctacacttgaaacgattccgccgcctttcacgacttcagtttcttcaacaggataaaagtttgtttctccaatttgatttaagaccgcttttgctaatggatgatctgattcccgttccacactggccagatagccaagcgtttcagcagaatctttttcatacagttcagtcgctgcaacggttgggtttccgacagttaaagtacctgtcttatcaaatacaattgtatccacattgctgaagtcttgaatgacttcactcccttttaaaagaacaccgttacgagcaccattcccaataccggcaacgtttgagacaggcactccgataactaatgcgcctgggcaacctagaaccaagatggtgattgctaactcaatattttgactgaacgcccatacaacaattgccagaaccaagacagctggtgtgtagtatttagaaaagcgatcaatgaaccgttctgcttcggatttagaatcttgtgcttcttccacgagttcaataattttaccaaatgtggtgtcctcaccaactcggtcagctctgatttgaatcgttccgttttctaaaatggttcctgcaaaaacttctgcatcagcttgcttattgaccggaacagcttcccctgtaatgctagcttcattgatatgcccttcacccgtaaggactatgccatctactggaactttcgcacccgttttaacgagtaagatatccccttcatctatatcatccacgtctacttcttcaaattcgccattatccatttgtttcaaggcgctttcgggtgccatttcagtcaattctttgatagcagatcgcgtttggttcaatgttcgttgttccaagtagtgtccgaataagaataagaacgtgacaatagccgattcttcataattttgaataaaaagcgcaccaatcgctgcaatactgactaagacatcaatactgatgactttgactttcattgcttgaaacgcttgaatggcaattggcgtaatcccaaagacagaggcgatgatcaaagaccactctgaaagtcctacgttttctaaaacaaagtgactgaagaaaccgagtacgattaacaatccactgatgacggtgataacatttttcttgcttaatatatattgttgcatgctttttccctccaaatttaatttctcttttattgataaacataatataaaataattgcctaagtaattaattgactgacatcaagtttagaaagttctcttttatcgtttctaagcacctcgaatcggattgcaacaaaaaaagcaatcctggaaaaatagcttttcttccagaattgcctagttcatttaatctgttaagcggccttgacttttgctttaaggaccggatagcctacgttttcgatagctttttgaatctcttcaatcgaagtgacagctgaatcaaaattggctttgactttgctggagttgaataatactttaatgctgtctttatcaacaccgttaactgattttacggcaccttcaattttttgcatacaacttggacaagacaacgtttctaattgcaatatagctttttccataattcctatctcctttatgtgtttttattttatcggcagcagattaatgaacactgccttttcctctttacaactgtagtatagctcacttttagcaaacgaaaattgacgcatatcaagttttgcacttctttttatctttttgctcaattcaccatcttaatagtctttttctgccccttattgccatcagaataataagaaattggtggataatcttgtctgcgtataaactatactacaatcgcgccaataaacagggccagagacaaggcttgcgaaacgcggatccactcgccaatccataaactgtccgttcgcataccttcaatgaagaaccgacccactgagtaccacaaaacgtaactcaaagcgacttctccttgacgcaaaagctgttttcggttccgtatagtgacgatgaggacaaagcccaacaaactccacaatgactcgtataaaaaagtcggatggtagtaggtaccattgatattcatttgttcaaatgataaattcaggtaaataaagattttccaagaattgacgagtaaccggcccaccatgagcttcctgattcataaaattgacccaacgaccaatggactgggctaacaatacattgggcgctaaaatatcaagaacgagtgccaaagaagtaccttttttctttgcataccaatatagcgtaccccctcctgcaatcaatcccccataaatcgcaataccgccattccaaatcgcaaggatttgtcctggattttgcagataataaccaagttcaaataacacataataaagccgagcgccgaggagtccaatcggaattgcccataaggccatatcgataatggtatcctcttccagtccttttttctttgcttccttggtgctcaactggagagccgctaatatgcccgctgcaataatgactccataccaatgaatcacaacagaaccaatctccaccacatggggattcaaaacgcctaatacgaatcccattctatttgctccatttcttcaatttttcgcgtcattctagtcatggtgatgttgaacaagattccggctaagctccatggaaaccaaacagtgaatacacttttatctccctggtcactcgcttcgtaatacgccacttttccgtgtccgattacgccggctccttttacaacttcctcttctttttccatagctaacctatctgcctcaacaacgttagacgtttttgcttcgccgccaatcgtgttcttggtgaaagggacgacaaagaatgcacccgctgctgacaacgtgatggcaactatcacccaaaaacaatgcacattcaccctacttatttttacgttttgttcgacaaccctatcttaaagaaaaataaaacaaaaaaacttgagggttatcatgtttgtgcttttatttttccaatgaatgaaggtcgttctgtcttaaaaaagccaaaaacggacagatggaagcaaaagcactgagttctgtcccgttgttaatgaagagcgacagaacaccaacgtgtagaaaaaagtgtgtccgattattcgctgtaaagcaataaatcatctaaatcctgaatcttgatccttttcccagacagctgttgaatcaatccctcgtcctccaattctccaaatttgcgactgatggtctcaggtgtcgttcctaaataggaagcaatgtccttttttgccatcggcagggtgatggtgggagagttgcccatttcaggttccacattttctgccaaaaacaaaactaaacgggtaatgacactctccacggctacttgtgtcgtttgacgttctgaactttctaaccgtttagacatttccgccaatagttttaaagaaatagctgggtattgttccagaaaatcttggacatctttttgctgaatcatacagacaacggtatctcgggttgcttcggcatattcctcgtgtactgcatccgggttgaacaaggtccattctccggtgaaatcaccagggctcaagatccgcactagctgctctttgccagagtctgccaatcgataaatacggattttcccacgattgataatatataaagtatcctctttttcttgtgaacgaaacagaaactctcctttttgatactgtttcgtgtgggctttttcagcaatgtaattcatcgcgctatcctctaagtgattgaatattggaaccaagcggatacaggctgcgtggtcgccaatttcatgatgggtatgtttagtcaattcattctccccctttatttattttgtttatattcgctgcttttattatataagtctcttactacaaaaaaattgatgcacatcaagaaaatggaaaaaggactggaaagaattccaatccctaaatcagcttctacttttaccttaatcttcatcctcatcaagagcgtcatcatcttctaatgcttctttaccaatgaacgcttgcagcatccaaatgttcttgtctaagtcatttttaaaagcaatcaatgtatcttctaaagcatcgtcaccctcgtcttgagctaaacgaatcgcgcgaatagttaggtcacgagtgcttctgaagtcctcgataatattttcaaccatgtcttctgctttagcgtatttattaactgcatcttccgaaagcatcgaatatttttcaaattcaaccgttgtcgaagcaggtttatgcccagaagtaattagacgctccgcaagtttgtcgaaccatttttcattttcgttatacaactcttcaaatttttcatgcaacgtaaagaaattggctccttttacataccagtgatattggtgcagtttcacatgtaatgtatgcatgttgcctaaaagatgatccgcaatggccgctgcattaattttcgtatgatgaacatgttccttgtgttcttgttcttcttgcaatctttcttggggtgttctttcttgagtagctttattttcagtcatgatttattcctcctataattttggtttgtttaaaatagctttctttgattcctcctttttctttactgaatttagtataggatagatttcagttaaaaaaattgatgctcatcaagaaaagtatttcttaatagacgccaggcttctctattaaattcaactgaaataatcaaaggaatgaagtcgttccctccaaacaaaaatttcattaaagtagggcctaaaaaaaatagcaactatactttgtcaagagacctgactgctatttttttgcttgttattcttcaattaccaaatgtcttgccttgcagtatatttaatgctctttctcactagtgttgcatgcaacactagtgagaaagagcattaataagattaacctagaagaataactttactttatttatgtcacaccataaataaaaattgaaaagaatttttttatttatttttagtagatcgattaataggagttttagcttgggagcgtcaataattttgtgtaaatggttcttccctactgtagattgtttctaattctccatcggttgactcagcatttgttcgagctcgccttcggcctgttggaaacctttatgactgcgacctaggaatttttggttgtaagtatcaaaagatgagactaagaaacgttccatcgactcttcattttggaactgttccttgcggtggctgtatttcttgatttgtttattgaaagattcgattaaattagttgagtaaatgcttcggcggataccaggcggaaactcataaaaagtcaataaatcttgattttttatcagtgactgcgtcactttaggataagttttctgccacttctcaatcatactccctaaaaaggtatttgcctcttcctttgagctagcttgataaacagccttaaaatcatcacagatttcttttcgatctttgacacatactttatgaacaatattacgggaaacgtgcacacagcaatgttgaaaacgggctttggggtagaacccgttcatatggaagtcctcttttctgtgaatgtgttgtggtaactctattctacacaagggacttccttttttctatttacacaaaatattttgttatcactgttgaatcatcatttataagtgaacgtaaaagataatagatacccaaaaacagaaagaaaaataacggtaatacacggagtaaaacaaacggagtttcaaaaatgaacgctttccaaaaccacataccctccatttcccataaaccttgggtaaaataccatgatttaaagttcaatatcttatccaaattccaagaattactactaaaaaaaataaagaaatacaataaaaatagagttccataagtataaccatattttacatatcttttctttacactttcttgagaatcagtgtcagaaaatatgtcccttgttacatcaggatattcttgctgaaaatactgagcgccaccagaacgacttccctttattagtttccaaccactatcagaaaacaatgttacataatcttcatattttatttttcccatacttttttctctaaaatcaaggcgcacataaggaataaacgtttctttactagccaatttttcaaaagtatatataggcaccactgaactaacagaaactaacctataaccttcttcttgtatagaattaatccattcttcttctttttttaaggataagaaaattctaaattttttcatgttatctcctcctaatatccaaaatcagaagatagcttaatcaaacttcctagacgttctatttctagtcttaaaacttcttctcccagatcagtaattttgtaaactcttcttcttttttccctacttggaatttcttctatccaattaagtttaagtaaattttcaatcgctccgtacatagttccagcagctaccttaactgatccctcgcttaacttatcaatttcttgaataatagcatatccatgagcaggtgtagttaaaactagcagaatataaaaagttgtttcagttaaaggtaaatatggatttctaatcatataaagacactcctcttaatatacagttccattatataaagcttaactatatacatagtatatgaattgacagacatcggtacgccaatcgtcaaacagcataatggtatcaatgagatcaccttatattatgacttgccgctcttcttttatttcatcatcgggttgaccttcattggttggctgattttattcatcatgtttattagaagtcggatacattcataaaaaaatgaggtcgagacaaaaatcgtttatgagaaattagagaaaaaacgaacaatacattttttgtattgctcgttttttttaaatttccgaaaaacctgcctttcggacgtcgtttatttgagagaggttaggacagaagtgtttaactctgagaaataagaagaaatgaacgaaaattgcttttcaaatttttgttcatttcggcttatttaagaaggagttgcttctgctcccgtcgtttattcgagagtctgtagcaaacctggtttttagatttgtcccatattcttattgtgacaatattccttcgtttctcttcactccaacgtgactgctaccccataatgatcactgacaatcgggccattttccccgtcaaaaatacgttgataacttgtaacaaagcaatcttgtggtacataaatatagtcgatacgtagcccctctttattgttttcccagccatcgattctcttttcgatcgttgcttcagcttgttttttttgcgcgattggataagcatcacgaataggcaactgactttttgccactaaatcgtacccgctgccttcagcaggattgttgaaatcccctaatagatacagtggtgttgtaagaggcgctaaacttgcttctaattctttccactcaaatgcaaatccgcttttttcatctacccaccaagaaaaatgacaacttgctacagtaatacattgtgttttgacagaggtttgacctactaatatttttcgagtatggtaatcctctttttcttttgtttcggagactaggtgcgtttgactagttagtggttgtttggaaagaagcgcattgccttcctcatagatagcatagccgatatgactcatttcccaactccaatagtaagtttcaccttgttctgctaagagctggatcaagcaataggcaaagttatccgagcggacaggcgtttgttcctgcacctgactaaaattcttcagctgctcactggttagtccttttgcgtccatcgtttgattgacttcttgcaatgcgatcacatcatattgttcatgacagattttttgagcgatctgttttaatttttcttgtggttcctcttctaaccagctatgcgtattcaacgtcattattttcatataattctccttcttaatgggatgggtcgaaacattgctcccaccttctggatccatataggtaaagaccccaaagtagtttattcaaaaaataagccaataatccctgaaataggaaaagcaatttcgggattatcggcttacttctaggagttacacacatcgaacacattctttcgatatgaaatacacacatgaacttctgtgattctttacaagtttattttcccgatcactgttcctcgttcagtgtctcctaatttattgatggtcagcccattgactttgtcatctgtaaagactactatgatcgtcgtttctttcccttcgttcttgattgcatctagattcatctgagcaatcgttgttcctgctactacttcttggccttcagaaactaagatctcaaacgctggctggctcatatgaacagtatccagtcccatatggatcaaaacttctgctccttctgctgtttgcatgccaattgcatgcttggttgggaagacactcacgattttaccagaaagtggtgccgtcacttctccagtggcaggaatgacagcaaagccatcacccatcatcttttgtgaaaagactggatcattcacatctgttaaagcaattacctcaccagttgctacagtgaataattctttttcgatacctaaaacatgtttctcttcattcttctcatttttatttgttgcctcaactgttggctctggaatatcagcgcctgattgtagtaaatcttcaatatccgatttcaacacatccgcttttggtccatacacggcttgcacacctttgtccttaacgatcaagcccatcgctccagcacgtttccattcttcttctgaaccgactttcccaggatcctcgacgctgacacgtaaacgagtcatacaagcatctacatccttgatgttttcttttccacctaacaaatggatgatcttaatgatttgttgatctgcattagttgcagaacctgacggcgtttcttcactgtcgttatcatagttcccattacgtcctggtgtagcataattgaattttttgatcaaaaagtttgccacaaaatacgtcaatactccaaataatatgacacagataacaaaattgagcaagtcgatacctaatcctgctttgatcgctaatggtgtacgtgtcaatagttcaatgttcccaaatgaatggacacgtaaaggtagaatatctgccattgcaaaagctgccccttggatcacagaataaacaatgtaaagaggtacagctgcaaacatgaacatgaactctaatggttcggttacacctgttaagaaaactgcaagtgctgctgaaaaatacattgatttatatttagactttttgtctggatcaacattacggtacatcgctagtgttaatcccatcaagataccggaagaaccaatcatttgtcccactttaaaacgagcaggtgtccagttcgtcaatacgaattcatattgcgacatgtcgccggcgcctttcaagttgaccaaatcagtcgcccacgccaaccataaaggatcttgtccaaatacttgtgttcccgcttgcgcaccagataatatctcataggtaccacccagctgcgtataattgattgggatcgtcaacatgtgatgtaagccaaatggtaacaatagacgttccaatgtaccatataggaatggtgctaaaatcggagcgctttcttttgactctgcaatccacaatccaaagttattgatccctgcttggacattcggccatacaatagcaagaatcaatgcaacaatcgttgaccacaaaataactacaaaaggaacaaatctttttccattaaagaacgataatgcgtcaggtaatttacgataattgtaatatttattataggccatcgccccaacgaaccctgcaataatcccaacaaatacccccatatttagtgctggtgcttctaatacactggtaaagaaccctttaaccatgattttcgtgccaaacaaggtatgcgtaaatgcgtcttcatttgccaacatctcattagtcacaccaaaaattgctcctgtgatccgattgatcaatataaatgagatccccgcagcgaatgctccccctgctcgttcttttgcccaactaccacctatcgctagtgcaaataaaagatgtaaatttccgataattgcccaaccaatattttcgatcacgccacccgttgtaactaaaggtgcaagatcaggattgatcaacggaatcgatttaccgatactgatcatcaaacctgccgctggcataactgccacaacgaccattaaagcctttccaaatttttgccaaaactcaaagctaaatatttttttcatttcctcgtctcctttgtgcaatcggtttcgttgttggttattatagcgtgtatttctttttttgtaaatgctttatttcgtatttttatgatttttctgtaagtacccaatcgttctttatacattgtttctgttcatattatagtagtaaatattgatacaatcgcttttgttttgttttttcatccacttcaaaatttaatttcacttttctagttgacttacgcaatcggttgcgtttattatggacgtataaacgacaacgtctaggaggagaacaatgaaacaaattaaacggttatttcagatcgacccttggaaaatcagcacgaataaattagataaagaaaatttacgcttgcaagaatcattgaccagtatcggtaacggatatatgggtatgcgcggaaattttgaagaagcatattctggtgatcatcaccaaggaacctatttagcaggtgtttggtaccctgacaaaacacgtgttggctggtggaaaaacggctatcctgaatattttggaaaagtaatcaatgcagtcgattttatcgctatggatctttttatcgatgatcagctgattgatctagctacacttactactgaagatttttattgggaattaaacatgaaaaacggtgttttgacacgtagttatacagtcactacctcatcaaacaaagttcgtctttcattcgagcgctttttaagtattgtcaaaaatgaagccgcttatattcgcttaaccattgaaatgttggaaggaaatggaactgtaaaagttatttctaagctagatggcaatgtccaaaacgaagacagcaattacgatgaacacttttggaatgacatcgatcatggcgtcaaggaagaaatagcgtacttaacgactaaaacgatcccgaataattttgagatcgaacaatttacagtgaccgctgggatgcgccactacgttgatggaaaattatatacgccaagctaccaggagggcaccttagcaatcgaaggttcattcacctttgacttaaatgaaaatgaaacacttcttatcgacaaagaagtattgattttcacaagccgagatatccctgaagcgcaacaagcgacacatctctttaaagaattcaacgaattgaacgttcactatccccaagcaaaagaggagcaaacagccgcttggtctaaacgatgggaattggcagatgtagtcattgaaggagacgatgaagcacaacaaggaatccgtttcaacctcttccagctattttctacttattatggcgaagatgaacgtttgaatattggaccaaaaggcttcactggcgaaaaatatggtggtgcaacttactgggatactgaagcctatgcagtgcctctgtacctcgctttagcgaaacctgaaatcactaagaatctcttgaagtaccgccataaccaattgccacaagcaatccataatgcacaacagcaagggctaaagggcgcgttatatccaatggtcactttcacaggtgtcgaatgccacaatgaatgggaaatcacctttgaagaaatccatcgaaatggcgcaattgcctacgctatttataattatactaactacactggcgacatcgactatttaaaaaatgaaggtttagaagtcttagcagaaatcgctcgcttttgggcagaccgagtccatttttctaaacgaaacaatcaatatatgatccacggggttacaggaccgaacgaatatgagaataatatcaacaacaattggtacacgaatacgattgcttgttgggtactacgttacacacgagaaaattatttgaagttcaaagaagagagcactgctaaaatcagcgacgatgaattggcacattggcaagaaattgctgaaaatatgtacttcccagtagatgaagaattagggatttttgttcaacacgatactttcttagacaaagatctcaaaccagtagcggaactatccgcaagtgaattgccattgaatcagcattggtcatgggacaagatccttcgttcttgcttcattaaacaagcagacgttttacaaggtatctacttcttcaatgattcatttacaaaagaagaaaaacaacgcaactttgatttttacgagccaatgactgtccatgagtcttccctatctcctagtatccatgctattttagctgctgaactaggcatggaagataaagccgttgaaatgtatcaacgcactgctcgtttagatttagataactataacaatgatacagaggatggcttacacatcacttcaatgactggaagttggcttgctatcgtacaaggattcgcgcaaatgaagacagatcatgaacaattaagatttgcaccattcttgcctaaaacatggtctgcttattcattccatatcaattatcgcgaccgcttgttatttgtcgccgtttcaaatgaacaggtaacattgaacctcttatctggcgaagcattaccgctagaagtctacgaaaaagcgtatgtccttactgatcatttgactattccattacgagaaggtgaagcgaatgtttaaaggtgtattattcgacttagatggggtcattacagataccgctgaattccattaccgtgcttggaaaaagctaggtgatgagatcggtattcccttagatcggtcattcaacgaacaattgaagggtgtaagcagagaagattctctgactctccttcttgctcacggaaaaaaagaagagcaattctcaaaaacagaatttctcgaattagcgaaaagaaaaaatgattattatcttgaaatgatccaatcgatcacaccaaaagatgtttttccagggattttagaattattaaaagacttacgggcaaacaatatcaagatttcactagcatctgcaagcaaaaatggccctttcctacttgccaagatgggtctagaaagctactttgatgcgattgctgatccggcaaaagtcgctaatggaaagcctgcaccagatatttttctacttgctgcgaaagaaatcggtttgacccctcgtgactgcatcgggatcgaggattcaaaagctggaatcgctgcgatcattgctagtggtgcgcaacctatcggcgtaggacgttcagaagatcttggggaggatattccaatcgtacctgatacagcttcattgactttcgattacttgaaaaaaacgtggcagccaaatgcctgaaccttctatttcagtgactcctatccccaacactgaattaaaaaaaataacattgaagaacgatgaattgaccgtcgttcttctaaattatggcgctagacttcaccaaatctttgctccagataacaaaggacatttagaaaacgtcttactttcttatgatgaactttcagatgttttaaccgatgaaagtttctttggagccacagtcggtcccgtagcaggcagaatccgaaatgctacatggggaaatcatcaacttgaaaaaaacgccggcaaccaccatatccacggaggaacaaatggatggtctttccaatattgggatgtcgaagtgttcaaaaatccacagtcgatcggcgttgtcttttatttacaagacactttttccgattatcctggtcctatcacagcaacgatcacgtatcagctaactgcgaatagcctggaaatgattacaaaaacgaacagtcccgtcgagacgatctgcaatccaaccaatcatgcctatttcaacctttctgggaatggtaaacgcgacattgatacacatgaactggctgtccaagcagaaagtctattggtattagatgaagataaactaccaacaggcgaacaaatcactcaagcggatttaccgatcaatttcaagaaaccacatacaatcgaagaaattctcaacgcttatccagaaggacttgatgacgtttttgttcttactacaccgaaacgttcaaaaaaggtgctgtgtctttcagaaaaacaatctggacgccagttgtctatagcaacaacaaatagaagtgtggtattattttctacgactggttttgaagctgattttatgatcaacgggaaacatatgcattcaaactatggtttagccatcgagccacaagaatttccggatctagtccatttacctgaactcggttcgatcgctttgtaccctggtcaagaaaaggtcaaccatacgacctatcagtttactattttaccgaatgaacagatagcaaatactcaatagttgcttgttttgattacgaatagctcagaaaagaagagatttttatttagaagaaaggtgtttaaattatggggttctgttgcgaagtttgaaaatcaaacgcgccctctctgaactccaaatatctatgttctttattttttagtatactaaaaaataaagaacataaaatccaatgattacttccttataaattttctttgtaaaaaaacttagtaaaaaaatatagagaaaaaaagtaataattattatttggataaatggaatccaaaaatcaacatctccactaggaggaaaaatagagagtgagtaaaaataaagatatttcatgtaaaaccatctggaaaacaaaaacgataaacatagtaatgaaacatttaaaaataacaattttattttaatttttatgctattaatagtagaattctcctttcaaatttgtttctattattataacaaaaaaacataaaggagctatactatgaaaaatatatgaaaaaaactatcgctcgcatttttaatactaagttttttttctgcaacagttgtaaacgctgctaccgctatgacatatagtgggactggtatttggtcatggagatctgtcaacagtggtctacttcaactacacgttcgtatactgttaggcataatctaactagacggagtgctggagcatctactgtgttgaatgttgctattgcacggcagaatctgataggctcaactatagtttcttctaggaatttttctggaactagcaacggtactttcacaagttcattaacttctggcacgtattttcttcgatttgaaagtaatgagcggaccaaaacatttgacataaatggaagtgtcacgtattaataatattctatctccttaaaaaaattctataaatgaccagtaaaagtacaattggccgttcattttactggttatttctaatgttttcttgatagatactcattatttatggtaatttctgattggtatttttttataggaactaataaagttaaaacggataaatctataaagaaaattattgaaggaaagactgttgacaaagaaaaactaagtgtgacaatatacgcgaaattctaattgttaaataaaaagcaaaaaattcaaattttttttaagccaaaataaaaaacgttgatttatcaacgttttttacagtatctattagtctcaaccatacatatatggagacggcgggagttgcttaaatgctattatatcaatacttaaatttagttgaatgccattttgaatgccacatagctagaaatctataaatttattgaacttatctgctaattgttctttggcaagtttagatacatgagcataagtattcatagtagtttggatgtcctcatgacctaatcgaaattgcacctcttttagcgaggcgcccatttctattaataagctagcttgagtatgtctgaagccatgtacggtgattctaggaagttttttcttttgttttttatccatttcatcttggatgtttaaaagccattttcgtgatgtatcaaggctcattatatcgtgtggatttttagcattagtttgaccgaaaatcaaccaatcatcagatggggggagtgctacttctttccattcagataacttgtctaaagtgctttgatcaattgaaataatcctgctcgatccaactgttttagttgtgtcaatttctagtcctttcgctgttctggtaacagctttacaaatattgactgtcttagctttaaaatctatatctttccactcgagagcacctgcttcttgttttctcataccagtcatggcaagtaatctaaaaaaagcctgaactttgatattcggttgctcatatagtacgtcgagaaataattttaattgcttcttatcataaaatggttcttcagtagtagtttttttccttcttttgggtttacggatagaatctgttggattggattcaatcattccaaatcgaacggcatatttaaatactagtcctgtataattcatcatcttagaagctgtatcatatttatttgcccatttatccattaattcttggattttgataggggtgatttcagaaatatatatgtctccgagctcttctaacacatgattcttaaaaattctttctgtttttaacaatgtagatcctcgaactgttcttttgtattcagtcatccataaatcatatacgtctctatatgtttttggtttttctttttttaataaattgtcttcgtattcactttgcaatcttgcgagtgctaattttgcttcacgttgagttttaaaatttcgccgagtagttttaacaggctttcctgtttcggggttaattcctaaataagcttggaacttccacgctttttcgccgttctttttcttatactgttcaaatgtagccaattgaatctactctctttctctgatacaataggcactataaataagcctattgtttgggttttattattttttgcacatcctttttgcttgccggcgcaaggatgtgctatttgtcgttttaatggtataattggatgtgtattagatcatccaatcagaggtgtttattatgattaaagtgatttttaaaagaataactgaacttccagagtttagattatttgttgattattggtatgtctggttttttattgttgcattgctgataggtctagatgtcatattagaaagaaaacttaagtaagagttgagttaataaattgaattcctaaatgagatattttgtagcccatattttgtttgccgacatcacctaatactatggagccaatcgttttttctaacagaccaaaatcagataatctatttaagctaccatctattagctcttgtgaatagccagacatgctgatatttccaataaaattttcgtttccacgactcattaagtatgctaacaattgaatctcaatcgatgttaattgattcagtacaagaagataatactcctcgttatcccatgaagcgttgttaattcgaagtaaacaattcttataaagatttttatacatatctattttattttgtgcctttgatttttctacctcgtcatttatcccttcgaatattccaatgagttggtccttgttctctaagctgaaaacatcttctggaatttgatcgcgaatgctttctaatgattcgtttaaatttttgtagaatttctcgatgcgtttgaaacgcttctcgtttttagacccaaaataaagtgactgcacaacgccaccaatataaggaattgctccaataccgccttcaactattaattcaagatattcttttttggttagtttttcattgctattatccatagttacctcctattttgtcatttcctttacaagcattgtgactcctgatggcactcttttgtataggttttattattgtgcacaatctaactcttagtggggcgtggttcatttattttttacttactttactattaatcatatcccattgagcataggatttttcgatgttcgatcctcttgaactaatttctcctgtaaaagttactttatctccttttacaaatgtatcggcattttttacgtccttagcaaaaattacagaagaaactttaggtgttgtagaaatatcgttccaatttttaccatcgtattctttgtctgctataatggctattctagtagtcattgtttcgataacagttccttcaaaagtaaatgtttttccactaatatatttagtaaaagctgtattttgctcagtaactggagaaatagaataataactatctaagaaagcaccccagtcatggttatttgtctctaaaaattcttcaaattgagttaagctttcattgctgctgttagatgtagtagttttagtctcagacgatgagctttcctgtttattattgtcatttgtctcgtttgatgaggaaagtgagaaacctatggcagtaaaaataatcccgataataaggataatcataggtgttttcttatttgtttttttgataaatcttacaatcaacatgattaatcctataataaataaaacaataccagtaaaaccgaatatgccgtccattaataaatcatccttttcttttgatagttaatattacaaaccaagcaattcttttttcttaaaatcaaattcttcttgattaataataccttcatccaacaactctttatactttttaatttcatctgcacttgaaatttgtgtttctttggaattattatctaatctagattgttgcttctctatatatttttttaaattttccatttcattccaatatttttttgtaaacataacggtgttttcatctttcgtggccgctaatattcctccgcgactttcgtttccacccagcagagtaaattgtatataaccattgctcatacctggtttttttaattgtacggctgatatatttttaaaaggaatagttttttcacctttaataccttgattaactagatttataaatccttttctaataattgaaatagaatcgtcagttactttaatcaaggtttttcctggagattttattaaaatctctttttccattttttcttcctcatttctatgatatgattttttagtagaagctcatatatgaggaaagagtccgtgttgcagcacgggcttttttctttataacttttttagagattataggcaaaatagtagggcataaaaatatattattgaattccgtatttagaaaatcctaattgaacttcaccggaagtcttttgctgtgttgtacgcaatgcttcttcttcagacattccattctgtactttccatgcaacaggcgacatcccgtatttgttaacaaaatcagtaagtgataaagtgtcagcgtcttgctgagcgcttgtttgttggtcttctggattttgttgagatgctgcttgttgttctttctgatcttgactgataatattgccagcatcatctgtagtcaatccattttcataaagggccacgccgaaggcttcccactctttgttggaccaatttgcacgatcagctggagttgactgtaaagtgcgttgtttcatctgttcatatgtttcttcttgaggtgcggtttggattgtactctgactggagcttataactgttgggctaggttccgccgtaacttggttggagcttgtaactgttgaactagaatctgttttagatgtagatttgctagtagatgaactggtttcagttgtttcttttgttttacttatttttgtttcttggttagaagtggcatctgttgattcagcttttttattatttgaacaagctgaaagtagtagagcagtacttaacaacaacataacgctaacttttttcattttataattcctctttctcgttgtaatatgtgtgctaacacgagcttttttatataagaaaacgataagcgctttctggaagtccgtaaagattctttaattcatcgatttttttaggatattgatcattatcttctttataaagagaaacaatgagattagcagcaaagcaattagcttcgctttcagatttgcttctagatgttcttgttgatacatagtaactggataagccacgatgaaaaatagcgtggcctaattcgtgagcgcaaatgtagaatctttcctcagagtctcgcagttcatcatttaagaagattattgcacgacctctaatttcttgaaactgtcctttgggattttcgataaaaggaacgtattgaattttaatgcccatcttttcacaaatataaaaaggattagcggactggtatttacgcttcaactcctcgactaaattaatcgtatccatctccataaactcacatctttttgcctttttctttgtcttctttcacaatatcccagaaagtcgctataaggatatcttttacgcgctgtatttgttcaggtgtcaatgtttccccaccataagacatattaacatttgagtctagtagtttatcaagttcaaccacttcctcttttgtagcccatttgggaacattattatttcccaataaataatcagttgtgacaccaaaataatcagcaactttctttaagttctcagatttcggcgaagctttatcccatcttcttatttgtccattagagatgcccacctgtctttctacttctgctatagtcacatgcttttcgtctgctaattctttaatcttagtaactaaactcattattatcaacctttcaaagctgaaaagaaaataaatagcttaaaagttatatttttagttgacaattagcttttaagctagtatatttaattcgtaagctaaattgttagctaaataagagcaacaaaaatctctactaatttaaaacattctctcggtcgccaaacttagaaatgttattttagaggctttttataagtcttatttaactatgtattcataatagcttaaaagctaataagtgtcaacgatttagctaattttttagcttacaaattatttgtttagaaaggagctatttttatgtctgagaatttagacttaaaaattcgagcggagatgagaaaaagaagaatgactttcaaagaactagctgcgcttgttggtatttcaggagcttatttatcagatattctaaacggcaatcgtgatggaaagaaagcacaacagcatatcgaaactgtaaaagatattctaggaattcgatagggaggaagcaacatgaaccaggaactaatcaacaaaagcgagctagattcattacttgtaggatatgtgcctaaacgctatctgactcaaaaagaagcagttcattatacaggaacgtcagcaggaactattaacgaatgggtaaaaaaagggttgaaagtaatcatcttcggtgaaaatagccgtccgaaatacgacatcaaagatatcgatgaattcatgtcgaaatataaagtttaaggaggtaagcggatgggaaaatttaacagagcattagtattcagcgcaccgctaatcatctacgctttaggactttggggaagcaggcaagcgttgataggaacgatcgtttacatggtctggatttttatggggcttgatgaagctgagtacaaaacaaaaaagccagtcgggagggactgactaatggtcttcctaagaggagtaatcaatatttttttcctgatttttatattagggttctccattgatttttttctttattttttgcagaaatccgttaatactttttttctgattatcggaaaatataaaggaaaaaatagcaataaatgaaatcaaagtggtcgctacagaaaattgtgtttcatttaaacaaaataataaagtgattactatggaaaatataaaaagaattttgactaaaaaacccatgaaaatcatatctttatcagtaaactctttatttttaatctccttgtatacccaaaaagttgatatatagaacataaatatcagggcggataacatacacataaaaaagaatacaattagtaatttgggagtatttagaatcgcaatttgctcttctaacaaagttccatccaagtttactcttttaagatattcgaaaagcaacaataatgcaacaattgcaaaggttgaaaaaagtaaaatatatagcaattttttcaaatattttcaccaccattttttacctaaattatatcaaaaggagagaagaaataatgcaagaattagtaattttgaaaaataaagaagctgtaactacgagcttgcaagtggcagaaagcttcaaaaagaaacataagcatgtgctagaagcaattgaatcaataaaaagatcggtcgaaaattcggccaatgttgaagatgggtccaattttggacagatgtttgtggaagggaacgagccagactcatacggaagaagtcggagagtttatttcatgaatagagacggattttccttgctagctatgggatttactggaagtaaagcaataagtttcaaactaaaatttattgaagctttcaatgaaatggaaaaatcaatcaaagaacgaatgatcgctattccaacgacacatagagaaatggctatgttagctttagctgcaaacgaagaaacgaacgaaagagtagacgctatcgagtctgatttaaacgatttgaagaacaatcaacttctagctgaaccagattaccgaacaatttctaatatggttcgcaacaaaattagagttatttgtaatcagcagcatttaaatagcaaagcaaaagcagaattgtttaaagacttgaatggcggaattaagcgaatcactggagcagtagctagaaatcgtatcaaggcaaaacagttcgatgatgttatcgagtttattaacaattggatgccttctacagcgacgatgacaattattaagcaaatggagttgttagaggatgaatagagctgaagcgctaaaaataggcgtaataattgctaatcgctggtggagacacaataaaccaatcatcctaagccaacaacatattgacaagcaaaaagcatggcaacaaataaaaaagtgactccgccggcaagcaaagagtcacaaagaaaacacatcataaggagattttagcatatggaaaaagaactttccactctagatcaatatttgattgatcctgattggggcaagccgaaaattgaggaaacaagtggtcgaaaaatcaggcgaaatcttttgacgaatgaagaactagcttgtgatcaagatgatttaggtaaccttgtaactatttgggatcatgtttatcttatccatttatcgaagcattcgaataaacctgaatatatttacgtcatcgaagatggcttgattgatgcattagaagagtacgaaagggataacttgatcgatatctcttattacggaccaggtaagaaatacattgctgaaatggaggcagaataaatagaggagaacatcattcgtcaatgatgttcccctctaatcttagtatgtttttccgaataaatggtgttccagaagtagcttcttcgaaaaataagccgaaatttcacaaaaatttgagaagcaattttcgtcaattccttcttgtttcttgaagctgaccacttctgtcacaacctctatttttaaacatattagtggtgcgtgcccatgtttccttattttaattgacgcgctttaggaagagatacctcatttttcgtttttccagtttctattatttcgcggaagttctcgaagcttgtcgaaatcatatttgacaatgcctcatctgtatttgaacctacatgaggggttataagaactctagggtacaattctactagttgctggatagcaggatctggaatcatctcccatggcttgaaagatcggaaaaagacatctgtttcatttgcaaaaacatcggttgcaaaaccagctaaatgttcacttttcaaagctcttaaaatagcttcattatcttgaagctctccacgagctgtattgatcaagatactgcctcttttcatttgagccaaaaatccttcattgatcatttgatcgttttcacctgggatgtgaggtacatggatactgacgatatcgctttttgctaacaattcttcgagtgagtgaaacgtcaatacttttttagcagcttctgtctgatggatatcatagccgatcactttggctcctagccccttaaacaaaactgcttccgtcaatcctattctgcctgttcctatgatacctactgtgcaatttctgatttcacggctaaacatttgttcatccactcgaaaatctttgaaagatgttcggatcgtcgtatacgctgtatttctcaaaagcatcatggcaaaagtcaaagataattctgctatagcatttggcgaatatgatgggacacgggctactgtcataccaaaatcagctgccgcttgtagattgatatgattgactcccacagttcgggtaaaaacatagcggatcccatatttctgcatttttgcaagattgatctcatctgctatacaatttcctctcagcagtacagcatcatgggccatagctgattcaatattgtcatgcgtcagtagttcttcataaagactcagttcataatggtaaatattcaattgctcaaaaaaatcgatctcattcggacgaacaccataacatgcgattctcatactttcctcctccatttcctatcaaaacaaacctatgccgtgaatcatttgcaatacaacgatccatacaggtgtcagtactacagcaaaaatagttgacagtaaggatgcattagaggctaaaagtgcctccctatcaaaactgatagcataggctgctgccacagttgcggctggtgtagccatcatgataacaatcgttgccagtgcttcaaaattgaccggtagaatatttgttgccgtcaaaactgctaaaatcacgatattcaatgcaggtacaaataccactttgactaaactgtaataccatgatgttttttcagaagcagcttttttgaaacttacttcacctaatgttgcgccgattgctagccatgccaatggcgaacttaaaccagctaaataatccattggctgaaatagccaaggtgctgtctggtcaattcgcaaaaacgctacttggcttatctctccttctgcacctgtaattgacacttgtggaagatatccttggaacagccaaatgaaaaggccggcaaaagtagcgatgatgattggattaacgaacatcgctttgatatttttggcttccatcttcaagccactcatttttatgtatccataagaatacaaaaagatccgataaccaatgttgaaaatcgaggaatacatcacgccgaccggtccataaatcgcactgacaatcggtgtcccgaaaaaggtcgtagaaccaaagattgtcaggacacgcaacgttgattgcttatcccctttataacttaagaaaaatggccttgaaactagaataagaataatataaatcactaacccccaaatcaagacattgattccttgcatcaatagttctgtattgatatcttgcatgaaagctcgaaatgcaagtgctggcagagccgctgttaagacaactttcgataggatttttccaacagattcagaaaaaatttccttttttctacaaataaaccctaataatataataaaaactgttgaagtgattgcactaacaatcgacatatctgtcaaagtcgatcggaaaatatcaaataaattcatcttttccctcctattaatgttcatttattcacaattcaaaatgcttttatttagctaatacgtattaacattttttattttatctttatattgttaactattgaacaataaggaattaaagaaacttttgaaacttatgtaaagtgatattcgttagaacacaaaaaggagcgtgggacaaaagtaaagaacacttttgtctcacgctctaaacacgtataaacggcggaagcagaagcaactccttcggaaataagctgaaattcacaaaaatttgaaaagcaattttcgtgaatttcttcttatttcttggagttaaacgcttctgtcccagcctctatcttagattatattatgcgtggaaacgttccacaccatctagataagttgcttccaatgtcatatcagggttcaatacgataaagtctgcgtcgcgtccttgagcgatttttccacatgtgtcatcgattttacaactgattgctggaatcagactagccatcatgactgcttgttctggtgttgctagtccccaatccacgacattcttaattgcttctttcaatttcaagatgcttccagctaagttgccagattccaaacgtgccgttccttcttttactactaccggaaattcacctaaattgtaatttccatcaggcatcccaccggccatcatacagtctgtaatcaaagcgacatgctcatgtcctgctttttccattaggattcctgccgcatttggatgtacatgatgtccgtcacaaatcaattcagaaaagacatgttctaaagataataacgcacctaccatacctggttcgcgatgattcaatccgcgcatcccattgaaagcatggacaaacacgctggcgcctgcttcaacagctttttgcgcttcttctagcgtagcgttactgtgccctagagaaacaactactccttcttcagtcacttgtttgacaaactcttctacaccttgacgttccggtgctaaagcaatttttttgatcaaaccgcctgaagcttcttgccattcatggaaagtatccaaatcaggatcaccgaaataacttgggttttgtgcccctttgtgttcttctgtgaagaaaggaccttcaaaatagattcctttgattttagctcctggtgcttcttgatacattttgccgattgtctcagctacatcttttaaacgttctttgcttgacgtcaatgttgttggtaaaaatgaagtcactccacaagataatagaccttcagacatcactttgataccttctgcatcgttgtccattacatcatgattcatatagccgtgaatatgtgtatctaccaaaccaggagcaatccatttgccgctttggtcaatgatgttgacttctccctcaggtagttctttggtgtattcaccaaaaagcccatcggtaatttcaagatagcctgcatttttgacgcctgacgctaaaaagaatttgtcagcatagataaaagttctcattctattctctccctttgtttttctacctctaaagtactcttatttagagaagaagtcaagaatggtctacaccatttatagattttttgaaatttgtttcacagcttgtgccaatccttcataaaatgctgctctttctggttcttctttacgcttgtatatcaagctcttaagcacaaataaatcattgagataatagtaactatttttctcttgagcccaatagattccttggttcacctgctctagtgcttcgtcaatttcattttgatggaataagaaatttccataattataaaaaatttgcgaaaattcactttttgatcgttcatcagctgattgatgcagcagttggatgcttcgactcaaatagtagcgggcttcagcagtttttcctgccacaccatatatttttccgatacaactaatcagttgtatttctgtgtcagagacatggattctttctttttggctagagtagcttaatgcttcttttaaataataaagagactgagaaatattttgacgcaacgtgaattcacaaacaccgagataataataatatcgttgaaagtcagttgcttgatacagattctcagaaatatcagaagattttagtacttgttctaacttgcgataatcacgtttttggaaacaactatccaacagttcaaataatttatcgtttgtccgagtagtttttcgagagagattcatcacatgatcaatcgttactcctagccgttgacaaatctgcatcatcaccaatacattcggcagttcctcattattttcgatccggcttagtacactttgtgaacaaatatcttgcgaaagcatcttttgcgtcattttttgttcttttcgaatctctttaatgattgtgccaaaggactcgattaacgtttccataagtatcctccccaaaatatgcgtattcgcattctatccgtattttactttaggaagtcgcaaacttcaagaaaagacttgcaactaaataatatgactttagttatttaagagatctccattagaaagagagcctcagtatatttgtctgtggctctcttgctggaaaatttgcttttttttaagtcacttttgtcgatatgtcgctaaaaattctctcattttcttagctgtttgtttcaaatcatccattttaggaagatagacgatccgaaaatgatctggttggttccaattgaatccgccaccgtgtacgagcagaatatgatgttcatgtaaaaagtccaagacgaatttttcatcatccaaaatattgaatcgttttgtatcgattttagggaatatataaaaagcagcttttggttttacagctgaaagaccaggaatatcattgattgcattatagatatattctctttgctcatagatccttccgcctggcaggagcagctcatcaacactttgataaccgcccagcgccgtttggatgatttgctgagacaagacgttagaacacaaacgcatggaagacaacatattcagcccttctatatagcctttgacgtgtgatttatctccgcttaggaccatccagccgactcgaaagcctgccacacgatgagacttggatagaccgttcagcgtaacaacgaacaaatcaggcgctaatgtagcaatcggaatatgttctaggccatccatcactaagcggtcatagatttcatcagaataaataatcaggttgttttgtcgggctacttcaacaatttcttctaacaattcttttggataaagtgccccagtaggattattaggattgatgatgacgatcgcttttgtccgactcgttatttttgatttgatatcatcaatatcaggataccattctgcctcttcatcgcaaatataatgaacaggtgtacctccagctaaagcaatcgaggcagtccacaacggatagtccggcattggaaccagtacttcatctccattgtctagcaacccttgcatacacatcgtgatcagttcgctgactccgtttccggtatagatatcattgatcgtcacattcggaaaatgtttcagttgacaatattgctcaattgcttttctagcagaaaaaattcccttggagtctgagtagccttctgaatcacgggcattcatgatcaaatcacgaatgacttcgtttggtgcctcgaatccaaaaggtgcgggatttcctgtattcaattttaaaatactgatgccctcttcttgcatccgctctgcttcttctagaaccggaccgcgaacgtcgtaactaacaccttctaatttgttggatttttcaaattctctcatcacttagccaatccctcatttcaaaaagttagaactttccaaattttttgttatttactatttcaatatcatactccatcctagaaaaatttgccacttatttaggaaaaacataagtatcgaaaaaaatgctgagaagcgctgagaacttactggtcatgatagtcattccatagatttgctgcccaatccattgcaatcccacaaataattcccagcatcaacccaaatataaaacgaccaaatgcaaggccaatcaatatgcctaggatcatccccagtcctgaaaattctccgtcatatttctccatcttcataagacctcccactttttgagcttgacaactatgtaaaacctcgctatcattattgtgttattatttatgcagacgtgatggaacggcagacatgcaagattgagggtcttgtgagcgtacgctcgtgtgggttcaaatcccatcgtctgcatttttctttcaaaacaagcggctaggacatttttgtctcagccgcttttctttttctcgttcattctttcatcttattggaccttttttcttgggtatagacttttctcatattctaccacaatttttggttttcctaacacatgataagatctcaccacgaattgttttctattattgtaatatcctgtaacaactagtttcatcccttcgtctacttcagctaggaagttcaaactatgggaagcaatcagacaattgacctcatttaagctaaaacgaatcagtggtctggcgctgacctgcaacgtacgaatcttatctactgttccatattttatctccattgccttcacctcattactattatacgaacatacattcccttttgtaaagaagaaacactttttatcttgtgatttttttgtccagctatttttcttaacgaacatataactcttcttgcgacgatgaaggactacttattaacaaaaaagcggcaacagcataaattgctgtcgccgcattgctgatcaagggttacttatcataaaagattatttactcaaatgttcttcaacgatttgttgagatttatcagctgtatcttccacttcgccttttgctttttctaacttttgaatatattgtttcaaacttgtgttttcagcagttgcttcgtctaattttttttgcgtatctgctaactgagtttctaaatttgctttttcttgtgtcagtgttgcgatttgttggttcaaaccatttacagtattttgtaattctgaaagttttgcttgtgcttcttgtagtcttgcagtccaatctgcattcaaacgattgatttcatcatttttttggttgatttcgtctagtttcgcattgatttcattttgtttgctttgtagttgtgcatccttgctgactaattgactttctaagttttgtttttctgctgccgattgatttttttggttttctaattcatttacttttgcttggtattcttggacatctgcctttgaatcttgcaatgtctgttctttttgtgctagttgtgcggtaagatctgtaatcttttgctctttatctgtcaacgtatggtcaagctgtgtcagattctcattgattgtatcgatatctgtctctccaccccacaaaataatttcatttgcgtaacgcgtgcctgtgtagccaattagacatagaaatgcaaccacaatcccaccagcaataattttctttttcattatgtagctccttcatttaatatttttactcactaaaagtaagtgatttcacatgcaatgtcaagcacttttaaattacaattgtatttttaatagaaacgctattaaattctcatttaatcttccttttttatgtatctgcaaaaacttttcatagagaaaaatgtaccttaacactttcttaaatatagatgtatagtaaaaataaatgaaaaaaactagtttttcttaaacgtaatccttttcatttcataaattactgtgtttattacaaaaaacgtggatttgtcataaattgtcatgcttcttttacctatgaaataatttttgagctatgtacaagaagcattttattctagcttaatttgacaaatcatatcatattgatcctcaaacagaagctacagatatttttacgtatattatcgcaggtttgaagtattctgaattcgaaaacaaatctcagacattggctgagatcggatacaatatgacagtggctagctgttcggcaatagttttaggaaaaaaatagatccagaaaacaagattggttgcgtatttggaatcgaacctgtttatccagtagattgcaatcccacaaatgtgatgaatgcttttaaacagatggatcgagatttctatcaaatagatgctatgtgtacaggcaagtttccagagtataaaatcaatgaatatgcagaccaaggaataaagttgaccataacagaggatgataaatatatgttttctaaaggaacacttgactttattggtatgaactattacgcatcatctgttgcgaagtacgaaggagcggctgaagaaaagagtgccttatttggcggtcttcaaaacccgtatcttatgactagtaaatgggggtggaccattgatccgatgggattacgatatctgctgaattacacttatagaaaatatggtctccctatcataattacagaaaatggattaggtgccatagatgatttgacagatgataaaaacatacacgatgaatatcgcatcgaatacttaaaacagcatattcaacaaatgaagattgcaatcgaaaaagatcaggtggattgctttgggtatctcacgtgggcacccatagatttagtaagtgctacaacaggcgaaatgaaaaaaagatatgggtttatctatgtggacaaagacgatgaaggaaatggcaccttagaaaggtacaaaaaggactctttttattggtacaaagaagtgattggttccaatggagatattttgtaatacctgtctaacatagaaggagttatagtagttatattcatataacaagtagttagtttagagtaatattactaaaggaccaaagttctatcttaaaaaaataactatctttaatatataaaatcaacaaatcataaacaccctttaaaaaagagggggcagggtgtagacaaaagtatcagtctacactctgagatgtaagaaatatcataagatatttcttacatctttttgttttgagcaggactttagataattttattaatatatgctagcatgcttttgtaaataaaagaaagagggcgtttgaatatgtatcttaaaattacggatcaagcacaagaaagattacaaaaatatattgatgaaggcgcgacagttattttggatttagatgatggtgtgggtgaatattctaaaatgggtgtttgctctttagatactagtttccgtttacttcttcttgataaagaacaaggaaaaaatgattataaactccaattagatagtgatattggggaagtttatatcaaagattattcaaaaatgtacatggatgaacacatgaccctttctttagatccacgtctaggtgtattcactcttgaaagtccaagtggttctttagacagccatgtacaattagtcgatctacgaccagaaaaattctctggcatgaaacaataattttctcttcattgatccatgatccataaaactagtctcaatcgagctacattgaaaaacaagacaacgttcttaacttggtaaataaaaaagacgacacattttgtcgtcttttttattgattagctatttttgataaatgatcgcatagcttgtgccattatttctggcttttctctattcaattcctgttttccgttttcgataaacaggagtcggctattagctgaaactttatataaccgttttgctccaggcttgtttgcataatcttttgtaccgcatagcataaaatcaatttaggaagtcgtgatgtacgaagctgttttttgcaatctaatgttttaagtaaacgaagtagggtaaggctttgctttttagaccaacctaattttttaaacattttaaaaggtacgcagtaaaaataaacattctagaaaataagcaataagcgattaggagattcaaattgtggatcaattaaatcgatggagtactcgggggcactgaaacatccataaagcaagtagccccgctatcgattgtcaacagagtcacttactttaatgtgattccattaatttggagaataaatgaactttcactctactccgatggtcatcctgaaagaattatcaaccatcggaagacctaacatttcctttccgaaaccaaattgatacacaacaaactcataactttccggatcacttggcgctttgaaagaaatctttccattttgtggagtcattttattggttttagaatctttcgataaccgaataggcaagtcagaaagaccatttagttcaatttgcttgtttcctaataagacaacaaggaagtattcctataatccctcaatacttggaccaactaagaagtttaattcaaccatttctcctattgatacattcaaataaggacttggattatttattaactcacttttagaatctgtaacatttgatccatattaaagtattcgcagattaactgaaaaagtcgttttttctttatttaaaataaaaacagttttgcgggattttcgtggcataaaataaaaaaacagcgcagacacattgttaaaccaacatgttgcactgtttaaggaagccacttgccgggcttgaaccggcgacctcttccttaccatggaagcgctctaccagctgagctaaagcggcattatcattaatacaaataataggataacgaatattaatgtatttgtcaatatattttttatcaaaaaaatgtgtttttgtactaatgaaacaattctcagaaaaaagtaaaaataacaaaaaatgctaacggtttcttctggaatatagtaaaaaaattcaaaaaaagtattgcgttatttgaaagaaattgatattatattcatgtacttgattccggcatagctcagttggtagtagcgcatgactgttaatcatgatgtcgtaggttcgagtcctactgccggagtaaataaagcttatgcaaagaaaaagaaatccaatcacttgggtttctttttcttttattattatgatgaatcaagctttctgtttttgtcacgtatgttgtaatctttacgagagagtagagttggctactcataatcaaccatacttcccatcatcgctaaatacgaaataaatcagcattcctacaccaatcaaagcacaagctgcaccaagaaaagggatgatattcccaaagttttctgtattcataagtatgccaccacccacaaacaaaaagccgccagcaatcaggtttttcattttattcattctcctttcttatgttatagtatttccttctttcaatgagtattttgaaagctatcttattgtatgatgttcttctaggcctcttctttattatacaggccattttcgttatctcatagaaatattcctttttatctgaaaattattgtataccatatgatatttttcttcatgaagttgtaagtatattctcattcaaatgaaaatttcatcatagaagagattgtatttctaaattcttaagagtaaaatacgaagtgtaacttggatttggaaggatgattggatgaaagctattacaccggatatgacaacaaaatttgacaaacagtttcaagcaaataacaaacagcaggcattgcagcgggctgtcgtgaagaacgggattactgcttctgctgaaaatatttcagcacatgtggcgaatacaccagtattttctattgatctggctacaggaaaagtggctaatcagatgcaatcgggccgttgctggatgtttgctgcattgaatacgttccgtcacaaaatgctgaatcaattccatttaaaagagtttgaattatcacaaaattacacttttttctgggataaatatgaaaaggcaaattacttctatgaaaacatcattgcaactggaaaagaggctattgatagccgaaaagtggctttcttgctaactactcctcaacaagatggcggtcaatgggatatgatcgtttcattattccaaaaatacggtgttgtgcccaaatcggtaatgccggaaagtgcgaatagttcaaattctcgagatttgaataactacttgaacaaactactgcgtaaagatgcagttgtgttacgcgaaatggttgctcaaggagaaacattagacgctattgaagaaaaaaaagaagaaatgctagaaagtatttataacttcttagccatctcattaggaacacctccaaaagaattcgattttgagtaccgcgatgaagaacagaactatcatcttgaccgaggactgacaccacaaattttttatgataaatacatcggtgtaaaattagatgattatgttagtgtgatcaatgcaccaacaaaagacaaaccattcaatcgttcttatacagtagagatgctagggaatgtcgttggcgggaaagaagttaaatacctgaatgttgatatggaaactttcaaaaaattagcgattgctcagcttgaacaaggagaatctgtatggtttggttgtgatgtaggacaatcttctactagaaccagtggcatcatggccttagatgcttattcgatggatgatctattcgatacggatttcacaatgactaaagctgaacgtttggattttggtgaaagtttgatgacccatgcgatggtattgactggcgttgatttagtggacggacaatcaacaaaatggaaagtcgaaaacagctggggcgaaaaagttggaaagaacggtttcttcgttatgagtgatgcctggatggacgaatatacgtaccaaatcgttgtcagaaaagatttgttgacgaaagagcaactaaatgcgttcaatgaagaaccaattgtgctagctccatgggatccaatgggtgctttagcataggtaaatagttcaataaagagtatgcattatagataaaaaagagctggcttaagtcagctcttttttatctataaagtccatctcctgctttttatggtctctgtgctataattctaaataaagggatgaggattggaaataatccttttatcatgaaacaagtatgatgacaaaatagaataaaattgggagtaggggggaaagtcatggatatccaaactgttttatctgatctgaaactaaatgggaaagtgattccagttgttggcggcgatgtgaatcaaacttatcgtataaaaacagagcagcgtgcttattttttgaaaatccatccgaatgtaaaaaaaggtttttttgaagcagaagtagacgggttaaaagagctagctgcattcgtacgtgtaccagatacgtacatgctgggtgaaacaagtgaaggcgcttatttgttaatggaatggatcgagccgggaaaaggagatcaacgagatcttgctgcagctttagctaatctccatcagcaaacagcgccgcaatttggttttcgaaaagataactatctaggtacacttattcagaaaaattcttttgaagaagattggtggatttttttctttaaaaatcggcttgaagcccagatttctttagcagaagaaacgaatcgttggaatgtacagcggcaagaaaagtatctgcgatttaaagaacgagtattgagatcggttgaacccaaaaagatcactccacgcctcttgcacggagacctgtggagtggtaatgtgttctttgaccagcaaggacaaccaatttttgtcgatccggctgtttcttatgggaatcgggaacaagatatcgcaatgagtcaattattcggcggtttccgaccggaatttttagatgcctatcaaactatatttccattagaagagggatgggaagatcgactgccgatttaccagttatattatcttttggcacatttgaatatgtttggagaaagttacggttcccaagtagatcaattactagaaagtttttaagaggagggcgtgtttttggcaaagaaatataccaaaaagcatgaagtttcatattacgagtgtgacatcaatcaaacgatgacatttccttcgatgttaggagtagttatcaaaacatctgaagatcaaagcgaccaattgggaagaggcagtgaattcgtcaatagctttggactgacttgggtcatcacgaattattctatggagattaaacgtttacctagagtcggtgaagtaatttcagtaacgactcaagccatggagtacaataagtttttctgttatcggaacttctggatccatgatgaagatggggaagaattagtcaaaatagaatctgtttttgtattgatggattttgtgaatcgaaaaatgagcagtgttaatgaagagatcattgctccttttgagagtgagaaaatcaagaaaatcaagcgtcaggaaaaaattgaaaagattgattcgggcttcatgctgccatatcgtgttcgtttttatgatatcgatagtaatcagcatgttaataatgcgatgtattttaattggatcattgatgtattgggatatgactttttgactacgcatgttccagaaaaagtaattattcgatttgataaagaagtagagtacgggaatgagatcgaaagccattttgaacaagtcccaatcgaaaatggtgtcaaaacaaaacatgaaatccgaatgcaagaacagctgtattgtgaagccaatattctatggaaaaataaataaaaaagaggttgtgacagaaatggtcagcttcaagaaataagaagaaatttacgaaaattgtttctcaaatttttgtaaaatttcggcttagttttcgaagaagctacttttgtcacagcctctctttcctacgattagtcaagtaaaaggtgtaagaaaaatagctcataaacgaaagcgacaaaatcaaggcacaccaaataaagccccgttcgtaaaaaattttcgatctgggcaaatcatagataccgtaagggattttattctttatttaaaactttgcaacagaaccatatcagtaatgaagatggcggcgagattgcgtttgaaggattagaagatggcgactacctgttgatggaaacgaaagcattaccagggtatcagctgccgtcggggtattggatcatttctgtcaataattcagaggaactgccggtggataaaatcgctatccaagggtatggcacccacgccccaccggccttttacagagatagcagaagtgccctgcatctaccgaactttaaccagtatacgctgccggctgccggtggcaaaggcatgatcgccagtatcatcttagggatcatggtgatgggttgcggcgtactctactacctgcatccgaagacgagaagaaaaagctcacaaagtaactagtagaaagagaccgccacggtcaactgtcgatgaagacaggagtcgtggcggtcttttatagcgttcaaaaggagttgcttaggtcaactacccacccaaaatctcatacaacacatacagctcccaatcagaaatcgtgatccggtaaaactgctccagattatacaaaatcgttttgatattcgcttcgaaaggtttgtcgttgagcttaaggctgctgagttcttccggtagcgggtaatcggcaccgccgagaatagtacgttccaccatcaaggccaggtgcatcgtcaagttgaatttcatcttggcattcagctgcagaccgaagcggcgttcacacttgtcggtggtgtcttccacctgacgaatgatcacgtcagggttgagaaattccagtttctccgaaaggccttctttggagaagaagtggatgaattcattcagcatcggtttgacgttgttgggatggatcaagtgatggaaggactgctccaattgttgttcagcattgtcatccagcacgtccaacagattcaatgttggtacagcgacgtcggtatccaagtaggaagtggtcaggatcaaggaagtctccttcaagtattccgtttcgtcggcggcgcggtcgatggcggcgctgagttcgttgtaattcagaatgatcagcttgatatccggcttcacgtattgttggcagatgccccgcagtttcttggaaacgtcccggccggaaatgctggagatgatgatgtttttctccacggagaagccttcaaaatattggacgttggtgacgaagttttcttccgctgccttggcgatggtgtggaaacggctactgttcaacagctgttggccgatctccaaagcgaaggaggtggtgaggttgttgattaccaaaagttctcccagaatctggggcttcaagctcttgtaaagctgggtcagagagcccatatccaccagcatgatcacgccgtcaccggtctcccgttccgagagccagttcttcacctgagccacgatatcatggaccgaggaggtgaggggcatattgatggcgtcgaaaaggtactcgccgcacattttgttggcgaccccttggatactggaggcggtgcgctccccgtgagccaccaagagggcgtgatagcggatctcttcattgacagaacctatgagtaggatcgccaacaagcatttggctgccggaatcagctccaaaggcagttctttggtcaataattgagccaagtgataggttcggggctgttccttcaataagcgatactgaaggttttcccagagggtcatcggcagttgattcttggtaaagtccaagaaacagttgacggtggcggtggcttcctccgtcaagggcagatcccctagtacgcgtcgattttgctcttggatgctagcggtcactcgttcccccaaggccgtggtgcagacactgcctgcttcatggcgtaagtgatgatgaaggctcgccagctcctcttgaatctggagcagcgtttggtcgctagctaacagttgttgaagctggacttgttgggtttgcaggtcatcaggagcaaaggcctcgttgatctggtcgaaatgcagctccaaggaggggcgttcgttgcctaaaatgagcgcaatggtctccgctgtcggattcttttgtaaagcgccggcacaatacatgcggatctcgttagccagactgccgacattgccgggataggcccgctcgctaaggtagtccaataattcctgactgatggccaagtcccgcttgatccgtttggcttcttgcaggaaaagatacttgatcagctcaaagcgctcatagatcggtcgttcatggaaagaaggcagatctatgatcacagagattcggcgataaaaggtgggcagcagaacttcctccggtgtttcggtggtggcgaataaaaggcggacttgggaatgttggagtttctcgtcttcaccgataggacggaaattgccgctatccataaattggaaaagtttttcttggttttcctttgataggcggtggacttcatctaagaagaggacgccttgatccgcttgcgccagcagacctttccgctcgccttcagcgccggtaaaggcccctttggtgtgaccaaaaagaatcgacgacagcagctccgggttgttggcataatcggcacagttgaagacgaaaaatttctctgctcctttggcgttgttttgtttcaagtagtcatagatcagcttggctaagaagctcttgcccacgccgctggggccatggatcagtaaaggcagacctaacggcggatacatcacagcggcgatacattttttgatggcttcccgggcgctgccttgactgccgataaaggctttgaagacgtcatcagtagtctcggaggcagcgctggcgggcaaccaatagacgggcttcgtgccggtctgtttgacagtgccctcttgtaagagctcgtttaagtagagactggtggcggagcggcttaagtcgatctgttgggcgacttcagcggtggtcagtccggtttcgttattggataaaacagctaataattgctggcgagtttctattttcatattgctcactcccttatggttttctccctactctaaacataccgtaaaagcgggtattcgtcatgtttcaaggtgattccggtcaatattggaaaaaatgaaagaaatgacgaagtatccctgccacctttgagcgacagggatacttctttttctattcccattcttacaaacctttagcagatccctagtaaacctaagatgatccctaggaacatgatagcgaacatcacgatgttgacgttgactttcttacgtagcaggtagaaggccagcaaagtcacacacagtggcacgataccgatgaaaagttggtccaaatagtcttggatcttcatcgcttcttcggcacctttagcagaaacttccaggatcgttttgaatttcacgttggaagccgtcatggagcccatcatcatcaaacctaacatactggaagctttggtgaggatcttcattccgccagattcgtacatttttttgatgaagctggcaccaacggagtagccgctgtacaaagcatagtaatggatcaagaaggctgggatgttatacaaagctaagaacacgatggctcctaagggagaaccagtggaagcgatggagatcccgatcccagctgcgatgacccgcaggatcccccagaagaaggaatcaccgatcccagagatagggcccatcaaggaagccttaacggcggtgatggagctgtcatcgaaggttgggtcttcactgttttgtttttccatggaggctaccagccccatgatgaagttgttgatatgcatggtggcattgaaccaagtggtatggcggaccaaggcatcggcccgttcttctttggttttgtagaaacgattgatcactggtaacaaggtgtacatgacaccgactgcgtggtattgagtggccccagtccggctggcattcatggtccaagaccgccagaagacggaccgcatcatttttttatcttcagggctcatatctttagtcatcttactcatgcgaagaaatcctcctcttcatcttctttcgtcataggggcaccattattgccggaatgagcaactgcaccgctttcgatatcccggatctgcaagtcccgttgggcacttacgacacagatcacgacacctaagacagcgacagccacagctggcaagcctaggtaagctgtcaaaacaaaacctaagatatagaagacagctagtttgttatcccaaagtaacttcatcaacattgcgaacccgacagcaggtagtaggcccccagcagcacttaatccgttcatcagattttggggaatattctcaacgaaggtgttgactgggccactaccggccaggatgccgatgaaggagatggaagcgatgatcacgtaatagatcacccaagtcccataatggagggcaaccaccattttttcattgccttcacgggcagctttatccaaagaaggtgcgaagatattcataaagacgtttttcaagaacataacaacaacggcagctaacataccgatcggcacggccaaggtcatggcagctttggtttcaacattggaaataattgcaaaggtcgttgccatcgtcgtagcagttactggttcggcagcgataacaccgccgatattgacgtttcctaagaagatcgcttctagggaggcccccatcaggatcccggttttcatatcgcccatcaagatcccggtcactagaccgacgactagcgggcgttccatcatactttggcctgttaggtaattacctgcgaaacagataaagacggctaacgcggccatggttgcgtgcatcaacataattttttccctcccttatcctagactttcgctactgcgtctttgagactcagctgtggatttgatggcaatacttggttgtagctgttgacccgagtcagttgggctaattctttcgccgccgctaattcctcagggtttaattgcacacttggaaagatcatcgtttttgatttcggatcggatttgtcgaagcggccagcgttggcaacattgacggtttctaggtcttccacgttttgggcgatcttattggcatcgctgacggagttcacgatcacgaacatccgtttatcttttccccgaggatcgttgaagacgttgatggcgtcatcgacttttcggatcaataatttcatgccgttgggcacggccatcttcaaggtcatttgcatgacttcgttgttggctgcttcgtcattagcaactactaacaggggtgcgttcaattctttggtccatactacggctacttgtccgtggatcaagcggtcgtctacacgaatttgggtgatcatttttcattcctccagttttgggtgtgggttggtttaatcgaagatcgaatcatcgtcttcgtcggcgatctgagtcggtaccacttgtacctgactttcactgacggcttgttggatctgttccaggctgagggcttcgtcaccgcctaagaataggacggataagatcactgccaggttggcattggtgatgatgacgatgttgtcttttttggcattcattagttcagtgaaggccttttggttgacgctgccgccgaagagatcggtgaagataaagccttgttcctccggttggacggaagcgatgaattcatcgatggcgggggtgtaatcttcgtcgatgatgtaggcgttgatgacttggaagtcattgcctttgtccgccagaatgttcaaggagctttggaagcctttggctaattcgccgtgagtggcgatcaaatatttccgcatgggtttcacctcgcttttgtctgtggtttcgatttgtttttacactttactatacgcaagaggtgtgccaagtttttcgttatgggagaatgttgatgtggcggtgtttatgctggatgttgatgtgtttaaacagataggagattgcttaaacagatggtggtagtgagcaaaaaaggtgggaataagaatggttttccggtactgagggggaattttcctgttttgaataatgaggggtgctagaattaaagtaaagggttctgttgcaaagttttaaatctactatcaaataaggtagaataatagaaaaagatagcaggaggaatgacgatgaatcattttaaaggaaagcaatttcagcaggatgtgattattgtagccgtgggctactttcttctagtctacacaccttaatttttctgtctagttaattgtagcctatccaataagtagtttttcgcacaaatcaggtcacaaataaaaaaacttctacagtcttttaaaaagctctgtagaaagttgatgtttgtcttgctttaagatctcctcaagaaatatgtttttttaataaatgaagctcctgagcaatacgatacaaaaggatgtttgcaccttttaacgagataggatagacctttgttttttctgtttccaaaccagtttgatagctagcagcatcgcataaaaccactcgtttttttgaacacaaacattcatcaggtaattcttctaaagaacgaaatagaatggggtttatttcagccatatcttcttcagcatacaaatgaaattgagttcgataaaaaaattgtttgactgaactttctgaaacaacaaatatttctatctcttgctgtatcatctgttctctggtaatcaaagaaagactcttaacaaattttcggatgaaattatcattccatcttagatgaatttggtttttctttttccaatcgtctagcacttctactatttttctgtatagaagctgttctttttctgacagtagatagattcgttccggtaaaaatacttgaccgtctgcccacaacgtacggacaaattgtaaaaaggattgcttaaaaataaaattgtctgcatcgtcgatttcagcaactgggagaatctgtaaaatcaattcattgagtgacaggtcattgagaacaaaatttttatacacaacttcgaaatcttttcttaacagctccatgttctcattggtataatttctgctattgaacaaagagaaaatataatagatatcttcttcctgtaagtgtaacatccctttttgctcttccaatccttgacagactaattgaaataatggcttcgtctccgcacttttcttatcttcttctttcagttcaaggggaaacgtctttcttccaattgcaatctctattccccgtatgataaaggacttttcatcttccgaatatctccttttaaaaaaatgagtctctacataatcgatcagctcgttacaagcttcttctacatgtggatttttactctcatatccttcccaattgatataacgtactaaagctagcagaatattccgcgaatcaaattctggaataatgatttctttatttttcaaataatcattttctttgaaaaaatccaagacgctctttttgatcgtatatactttgctcaaagaaataaattcaagatcagccagttctgtactcgtgaatatgcccttgaaataataacttaaaaactttaaaaaataagattgaccatacaaaaattgcgtaagctcagaaagagcgatccctcgtttaaatataagtttgtacttatgcttctctcttattttttcttttatgcaatattccaaacactcggctagactttctagatcatgaaggatcgtcggtgtggtcacccctagtgaaatagctgtttgttcgatatctatttcttggaattcaaataattgttcgcatagatacactttcctaaatatatttcgctcgatgtatttttccagcattcctgatacacgcctccagtttttcttatagttttatttaaacatatccacgaatcgcttttttatttactttttgtttagaaaacccctttcaaaaaccaataaaaaagaagccggaacaaaagtcggtcaagcttacaatcccagctatcgtttagataacttggcatcgcttggacttttaccccagccactttcaagaaaggttattcgaagatatcagcatctagttctttgactacgtccttcagtaattggatgccagctgcactgttaccgaatggatctaatgctggactgaagacgcctataccgtaacgatttggcacagctgccatcaagccgccacctactccgcttttggcaggtacaccaacatggacggaaaactcgcctgattcatcatacaaaccggcagttgtcataatcgatttgacgatcgttgcactttcttcagtaatgagccggttgccattccaaggagcgatccctttatttgccaatacagcagctaattttgctatacctgtagcggtgacattgacggaacattgtctgaaataggcatcgagtatctctggaacgtctccttcgatcatttgattgcctttcatgtaataagcaagagagcgattgatatcacctgttcttgattcagaatgatagatttcttcattcaatgtgatatcaggatcatcacagatttctttcataaatgatatgatccgttcaaatttttcatctgcatcttttcccgcaatcaaagaggttgttgcaatcgctcctgcattaacaaaagggttcatcgggtgtttgcgatgattgatctccatattcatgatagaattgaaagcaaatccggtgggttctgtgttgattgtttgaaagactttttcaattccgttatctttgattgctaataacaatacgggaacttttgacatgctttcgatggcaaaacgtacatcggcatctcctccctcgatcagttgttttgtatcaagatcataaatcgccatacctaattgttttggatccacttcagctaatgctggaatgtagtctgccacttgtcccgtttgatagtagtggaaattttttccaatcaattgttctaattcttttccttccatttgaataaccagctttcattttttatttttctgcatgctggaatttatgacggcatgcatagatcgtaaatggaataactaagacgataagataagaaacgatcagaatcgtttcataaatcccatgctgtccagctgcgatacttgcaggtggaacaaatgagatacaaaaagcaaaaagtgaagtcaaaagacctaaacaagcaacgattacttttacaacttttccgcctggaacctgataggctctttcaagactttcatctttaaatactaacttcaaatagcccgcgaaaaacataaagtacaacattaggtaaatcacaacagtcaatgacattgctgcaagaaacgaaagattattccccccgccacttaatgtaaagacggctgcccagattgtcgcaacaatcccatttgcaatcatcaaatgcgcaggaacaccatgtgcattttctttcgcaaaatattcaggaagtaatccttcttctgccgctacgtgaagtgcttttgaaggagaagttacccaagaagctatttctccgatgacacctaaacaaacaaggatcgcaaggattttcgcaacccatgcaagacttggatcaatgtgtcttaataaaaattctaacgattggatcactcctgtattaagagacaaaccctgttgagggactgtagtagccacagtcaatccgccaaaagtgtctaaaatgatggccagaatgaccaatacaaacattgctaatggataatcctttttagggttttccatttcatttgcatgactagcagatgtttctactcccatatacgctaaaataaaggaaacaaaaacaaccagcgtaggtaattttgaaaaatcaggaatcaatgttttcatagaaagtgtcgtttgtagtggagcacctgaagagacatagtggatccctaagccaaacaagactaatgcaggcaataagatcccagctacaaaaccgattcgagcaattaaagaagtgtatttggttccttttagctgagagagcaaaatagcccagaaaataatcaataagatggccaatttcagaaatttattgttttgtatagcgtcgattcccgttgcataggataatgcaccagttaagaaatacagcatagtcaagtaaccaacagttatctcaaaccattggaaaaagatagcggcaaatccaaatcgttttcccaatgtccgactgacccaagtatagacaccgcctttttcccagcctttcaccgttgccatctctgctgcacacaatgccacagggataaaccatagcaaaccgcctaataacaagaaaaatactaaactgaagccagaggtcgcaaatgtgggatattcatatagtgaaacgaccattgagatcgtcatggctaaaaagccgaagaacgttaatttttttgcaggaattttcgttttgctttgttgcatgaatcttcctcttttctatttgattttgtttcaattgcgtttgttaccaaagaagaaaaagtctaatccttcttcctgctcttcttttgtagtagtgatcgttgtgaaatgcatggctgattttagaatcgctgttgttagcacataggcatacacggcagtaatgatgacaccaatcacttggattcctaagaaataccagctgcttggattttttaataaatggctgttagatgcaaaaattccgatcagaatcgtccctgtgaatccgcccattccatggacgccccacacatcaagtgcatcgtcccattgtttctttttacgaaaatcaacagcagcatgacagacgattccagcaatgattccgatcaacatagcactttttgcttctacataaccagcacaaggcgtaatggctgccaatccagcaacggatcctgttagtacgtcgacaaaatcaaagccatttccttttacttttgcaataatcaaccaagtaaccatcgcaaatgcaagagcgatgaatgttgaaccaaatgcattgactgcttgatcatctgctcgaagtgcaccaccagagttgaaaccgaaccagccaaaccaaagtagacctgtaccgatagcagctgccataagactgctatgctgatttctttcgcccataggaatcttcctctgtccaagtgtgaggatgcatgccaatgaaccgaatccagctgtcgtgtggatgactgctccgccagcgaaatctctaaatcccatctgatccaaaaatccgccgccccatatccaatggcaaacagggaagtaaatcagcaggttccaataaacaacaaggataatatagccttttaaattcagtctccctgcaaaagctcctgtcatcaaaggaacagtaatcacgataaacatcagttgataaagaaagaacatcaaaaatgggatcgtcgctccatggaacatgttgggaaagcttgtaacatgtctcatcaaaaagaaatctgccggatttccaatcataccgccaatatctcgtccaaatgccaatccgaatccaccgaatatccacatgatcgttgttatcccaactgagagaaaagattgagtcatgatcgtcagtatattattctttcgtgccagtccgccgtaaaaaaatgctaaaccaggagtcatcaagcaaaccattgctgtacataaaatcatgaatgctgtatctcctgtattgataggtaatgtattcattttttcgcctcctttctacgtttacgagtataaaaaaaaatctacttgtatttttcttctgtttttataaatacattcttgtatttataaaagacagacaatcaataaaagcttggtgtgctgtgcttttttatcgttttgaccaaataaagacaaaaaaataaacgattttcttttatagaaaaccgtctattttcgtctttttttatttttcaagctattttttcataacgcgaattgtaaaattaagttagaaaaataaaaaggcatttatggtacactcaaattgttttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtagcccacggctacaataatcacatcctgctgaaattgctttcctttaaaatgactcatcgtcattcctcctgctatctttttctattattctaccttatctgatagtagatttaaaactttgcaacagaacctttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccattcataataattaagagctttaaaattagtatttattagatacttaaaagctattttagtattgataaattgttaccagcaacaaaaaagaagttacttagtgctaacttttgagcaactgctagaggaggtaggatatggctaattatcctgtaatttttattgtattttctagaaatgtaattattctcttaaacattccagcatatccaagtatatagaaaatttacgttttctgtatagttggatttgaattatagctatttgtaatttacttcaattatttcgctatagcagctaataacactataaagacacatacagcaactccttaaatgggtttcgtatgtgtctttatagtgttgatcacttcatattttagttggtcaaaatccttatcatatgtagcaatatataccactaaatttacagcatctttttgatcaatagctaaaagctgtccattgattttcaaaaagacaaaagtagctaagaaagcagtacgtttatttgcattatgaaaaggatgtttctttatcaattgtataagtaggatagctgctttttcataaatcgaaggataaacctcttcaccaaaagctgaggctcgaagttgtcctacacacatttctaaagcattcgcgtcctttacaccaatgggttcattaggagagtatttttttatttggatcacattcatttttataacatctttggcttctaggtaatgaacactcatttatcgacaagctctctaaaagtagtatcatattcagttaatgcttgagagattgctacatcgatctcatcagataaggtttgtttttttgtaattgctgctcgaagtttttcttcatctaaaaaaaccgtatctccaggatttaacccattttctttaagaaactcctttgaaatagttaatactactgaattccctacttctctgaattttctttctttgattgccatagtcttctccccttttttgtttgtatatacagtatatacgcttattgattttaaatcaatcgtagtccctctcatgtctaactctatagaaagattgttctttctatagaattaagaaaaaccaaaaaaatttttagaatacaaactgctatcccctcgcctatttatatataccatttattttatatgattatatagaaccttatataatttgtgttttccaaaaaaaatatagcataccaattgacaaacgtccctataattggtatagtccaattgtaggggtactcctctctcctacttattgaaaggatgaatgacatgaaaaatacagaaatatatcaaaaaatagatacaatcatacttcatatgcccgattatataaaagattttgttcaagatcgtgaagataaagatcaatcacctcgaaccactttagaatatctaaaaaattataagctcttttatgaatggcttctgagtgagtctatcgttcctgatacttcaatcacctcgataagacatttaactgcctatgacctaaacttgtacaaatctcatttgaaacgtcgcgcaaaagaaaatgtaaaaaaagatacaacaaaagctaagctcgaagataataataacttaggcctatccacttctactatcaatagaaatataacagcattgaaagttctatttaaatatctttcgaaaagttccaataatcctctaggaaaaccatacttagacgataatcctatggaccaggtagcaactatcacagataaaacaactttagcagctcgtgcaaatgccattgagaaaaaattatttctagacgaagatacacaaaattatctagattatattgccaatgaatataaaaatactttgagcaaacgagctctgatctattaccatcgagatgtagaaagagacctggcgatcaatgcactgattttaggatctggattgagactctccgaggttgtaaatattaacttagatgatctatctttggataagaataatgtggtagtaactagaaaaggaaataagagagatgcggtcaatatagcagcgttcgcaatggaatatttagctaattatctagctattcggaaagaaagatataaagtgacagaaaacgaaaaagcattatttctagcaatttaccaaggagaagccaaacgtatatccggtattgcaatcgaacggatggtagcaaaatattcgaaaggattcagagtccaagtcagtccgcataaactgcgtcatacattggctactagactctaccaacagacaaattctttggtattgactgcccaacaattgggacattcaagtaccaatacaacgactttatatacccatatagacaatgcggctacaattgatgcattgaattcattataaaaaaaagtccaactacaaatagatttcgtagttggttttttttatctctaatcatgcaaagattaaatacctaatttaaatccttttaaggaagcaccgatttcatcttctgtaattccaatatatcttttagtaatcgattgagaactatgattaaaaataaacattaaggtagcaatgtctctagtttttttgtagtagtgatacccaaaagtttttcttaatgtatgtgttcctatatcatctcttcctaatttttccgctatatccgcatatatctgatagacacgatcccttgttatatgtcgaccttgttgccgacttggaaacaaccaatcattttcttctttgccttcagtatataataaaatctcttctctcaaattatctatgaaaatcggttttcgcttacctgttttacgttcaacaataataggcttacttttacctcgtatatctccaacttttaatcctataatatctgacatacgtaaaccattattgattccaaacaaaaataaaaaactatctctttccggattacttgttcttcttagccaaaactgaaaatcttgtatctcttcatttgtccttaacggttgtacattatagctcactattgtttcccttcttaaaaatattctgagttcatgattatatatatactttaccataatcataaacttatatacatactctgttcaaagtcaagaaaatcaagggatttagtttatgattttatatcatttcagtaactcagaatattccgacttttttgtacaaaaaaattaaccttacttatatgaagattctaagctcttatttaaattttagacgggcagttatccgtagaagttcttagaatagctaatttacataattaaattatatgaaatttaagtttgaacaatatactaagaactccccttactataaagtgaaataaattagcatatgaataaccgtgctaccaagcttctcattaataaaatatttttatacccgtggtgctagttaattttttcctagaggaaaatgtctaaacatgttggtaaatcaacaaaaaaacgcatatagtagtctcaaaactcccaagaaatgaggactatttaacaaactacgatggttacgtcgtgacaactgaacattttgacttagccaatcctgttactaaagtcgatgatatccccgattatgaaatgtacagtcaaacaatcgatagcttaaataagcgttttggcaatcgtgttttaaaaggcatcaaaatcggttacatcgcttctgaaaaggatcggatcatcgactatttagccgataaagattacgatttaaaattactcagtgtgcatcataatggtcaatttgattatttagatgacgaagtcaaagatatggatcctgctattgtgattcctcagtattttgcacaactttcagaagcactagttgttatagaagcagatgtctttgctcattttgactatggttttcgggtatttggtctatccgttgctgaatttaaacaatatgaagcgcagtttttaccgattctagatcaagtaatcaaaaataaattggcattcgaattaaatgctaagagcgcttacttgtatgacaatttagcgttatacgaatatgtcatcgatttatatctttcacgtggtggtaccttgtttagtgttggatcagatgggcattaccttgaacatttccgtttccatttcgatgatctttttgctctgttaaaagcaaaagatgtgacggaattagcgatttatcaaaaaggaaagcgaattatggttccattaccagtctaaaaaaacgtcctcagcatcaaaagtgaggacgtttttttagatttctttttctaaaatcggacaaatacgatcttgttttcctaaaggaaaatgtttgatcccgatttttttaaatccatgacgttcataaaaacgaatacctgcatgatttttttcataaacagtcaaacgtaaataacgtttatgtttcgttttagcataacgattcgcttcatcgagtaaccgttgccctaaccctttgttttgataatctttgagcagatagagccgttgaatctctatagcatctttttcatcattgactttcatataaccaatgagtatttgatgatccttaataccaataaatttactggttgactgtgccaattctactgccaatatttcagttgtcaattgtgtctgtaaatatccttgcatatcaagtggatctgcgccatcgataaacgattcataaaaactgacaacacttacaacttgtaaagcatctagatcatcataatctaaatacgctagtgtgatttgattgttcatctaactcctccttttgacatagtatactataaatcacccgtggggctagttaattttaatatcctaaagaatatctcaaagttccttcaaaacgtcgttgtgctcgacttaatagaacactgtaagccagtaatatgctttcaaatctactctctagacaatttgagtgtaccataaatgcctttttatttttctaacttaattttacaattcgcggataaataaaaagaatcaatttaaaagtttttttcactcgatataactaatttgaataatacatataataaaaacggatagaatctgttgctttattgaatcacttgttttaaataatcaatagacaaaagctatctctaaacgtactttgtaaaataatatcatttaaaaattattagttaatcgttaaatataataaattaaaataagactataactatttattttggttattgcttttctttttcgcatattattaagtaaaaaaattagcagtatctgtaatatcagaagaggacgatcaccattttaaaagtcatgtttctatcttaagaaaagagagtaggttctataataatgataaaaatattttatgttctgttaattggttgtatcactatattgagtggctgtacagctactacagaaggtcaaacaagcatacctaaaaaaatatctcttacacaaaaacaattagatagagcagataggctgtcaggacattggttttatcatgaagaagatactagattcgatatcgagattacaagtgaccagatcaaagtaaaaaagaagaagacagaaaacaaggaagaggaaacaatttatagcatctataattatgaaaatgaaaatggaaagataagcatttatggaacaacggataaaagggaattttatatttctgaagtagatactgatacagtttatatcgggggtgggatagcagacatagaaagtgcttggcgggttaaagcacataagcaaactttagaatagaaattttattgatatctttttctaagaaatagttagtggagaggaacagggaggagataaataaatactgtatagattattatctgaatgatcaagaaactattttttagcttagagaagattctaataataaaaatggataagcttcttaatcattcggataacatcttatgtggatttcaatgatgtttataactaacgtaataaaaacctgaaacaaaaatagctccgccaataatatttccaatataaacagggataaaattcgagagaaattctaaccaagtcgcttgaccttcaaatatggcagcaggtatcacaaaacagttggccacactatgttggaaaccgattgccacaaaaatcatgactggaaaccaaatcgttaatactttgccggccgcatcttttgccccatatgataaccataatgctaaaccaacaaaccaattacaacctattccagaccctaatgcttgccaccaagaaacagcgattttatgatcagcaatatggatcacttggtcgagatagacacctgaatgagttaaaccaacaaaatgtccaaagaagtaggctacgaaaattgccccaataatatttgcaaaagtaatcactgaccaattcttaactagctgtgagaaggtgacttttttatccataaaggcaatcgccacagccatcatatttccggtgatcaattcaccaccgccaagaaggatgaccagcagaccgatagggaaaaccgaggcaccaactaaactagtcaagctagccatagattctgggatagaagcagagacacgtacgtatgccaaataacctagagaaatcatggctcctccgataaaccctaaaatcagtttagctaagataggtttttgtattttttttgctccaagatgaatactgatttccataatttcttctggtgtgtgcatgatacttcgacgcctactttcttaatgaattttcatgtgatgaaatatagtgaaaaaattcacatttttcttgttgattatatcatcttattatttatatgtgcatattattgtaaaaatttttatttaatcacattggattctaaaaaagaaacaaaaataaaagttatgtatatggtggtcaaaaagtaaataatatcagttatcaaatttcctgtaaattttcttgaaattatagcatattattactttaaaaaaatctatattttttataaaaaaggaaatgaataactgaaaaaattattataggagagaaaaaatatcaccataattggtttaggattaactgtatatttatttatataatttgtttatagacatgtgaagttatttgcagaacctttatttgtattatacgaatcaaattcctcaatcgtcaatgaacttgctaatttaatgatagccttgctgtttactcccgcgttgagagtcataactattttggtctgtttagtgctattatttttcgttaataaaaagaaataacgtagtatttcaaaagacaaagaagtgggatgatgattgctatagtatggtatacgtggtgctaggtaagtgagaataaacaaaaaaactgtagaacaaagaaatttttttctttgtctacagtctgaggtggtgacatatctttgtcaccacctttttttgtcgcacaaataattaatcggatattttatgttcatgttttttgtgttcaacgagtattgatagggaaaagatacattttagatgcttttaactgttaatttacaaaacaaggtaaacgaatagaaaaatgaaaaaatagatacggaagaatatgtttgattaaaaaatgccatgaagagaaggaagttgatgatacatgaaaaaaatatattcaaaggaaatcgattgttttagaggcatagctgttttagcagtgatattttatcatttgccaaatagtaagctaccaggcggattgcaaggagtaacgatcttttttgtggtttctggttttttaatggctaaaaatacgataagagatgaaaaaaacagacaattcagttttctacatttttactataagcgtatcaaacgtatttatccatttttactgttttctttggtcgtatccattttcatactggggatcagcaacattcgattgataggaaatattcgtagtgagctacctagtttgatttttggctataacaattggtggcagctgaatcaaggcgtatcttatttcgagtcttactttaatgcttctttatttaaacattattggtcgctttccgttgagctacaattttatttgatttggccatttttgtttattgtcatgaaacgtatgagaagaaaacaagtgttttacttaatctatacattgatttttgtttctattcattttagtttatttttaccttcagctaaggcatattatcatacggtggctaaactttttccatttttattaggagtttgggggtattttaatcgaataactattggccgtttctttgaacaaaacagtttcagtaaaatctggcttttactactagctagtctttgtctgatcctgttcccgatttttccttatacactaaatgaactactgattagtatttgttttgctttattgttagccagtgtcgatgatgtgaatattgcaaaaaagaccaaaatcgctagtacaaaactttcttttgtaggaaaaatcagttatgaactttatttggtgcattttccagtattgattgctctgacagatttattcaaacattatcatttgaaatatttggatatcgcaagtttattcactgtgtttttgtgtacattactcatgattactttctttagaaaaggagtgcagaagatgagatcacccaaaatttggacagctatggcactaatgataatcggaatttctgtactggtattacgtgctccagccaatcggttgaccgctgaccaaaatcagttgcaaagtttattaaaagaaaattctagtaaagcaagtgcaggagaaaatcaattgtcacaagagaaaaaaatattatttatcggtgattctgttatgctgggggcgtatcaggaactgaaagagacttttccaaaagaagcattggtagacgcaaaagagtcaagacaaatcactgcgttaccagaaatcttaaagaagcataaagatttagtttcttaccaacaaatagtgatcgggttaggaaccaatggtgtgttaacagatgatgctatagaacaaaccatgtctttgctcaaagataaaaaagtgtactgggtaaatataaaagctccgactggctggcaagagacgataaatgccacattagctaattgccaaatcagtattctaatataacgatgatcgattggtatagtgaaagccaaaaccatcctgagtttttttatgatgatgaaactcatttgaatgaaagcggacgtacagcttatgcaaagtatattgcttcagtgatccaataaggtagtgatcacgtgttttaaccttactttttcctaataggtgaatcattttaaataaaaaatatttcatatgataaacggtgtttaagaggaggagttttttaatattcgtggtaaaaaagagatgggcgaggtcgttaactgagagcttcttgaaaagaaatcgttcgatgttagaaaatggaaatatcctctttgttatacagaacatgagcgagacgacaatactaggaattatgttctgatcgaagttttatggttacaagcagtaatcagcttagataaaattaaggaccgtagaaaccaagtaaagaaggctgttggtaaagaagcaaatgatcaagtatgttttattctcagggagattcacttcaagtagtaagaaacagtgggtttagctaaggggaaagtagctcacacagtgttacttaagaagatgcagtgaataaatataatagtagtataatgctagaaaggactgtgacaaaagtcgtgtcacagccttttttcctacgattagtcaagtaaaaggtgtaagaaaaatagctcataaacgaaagcgacaaaatcaaggcacaccaaataaagccccgttcgtaaaaaattttcgatctgggcaatttttgagctatgtacaagaagcattttattctagcttaatttgacaaatcataaataataaataatattcctcaaaaactgattatttcttacatatttaaataaaatacttcccttcccaataaaaatacacttataataggaaagataaacagctgaaaagggagattgggagcgtcaataattttgtgtaaatggttcctccctactgtagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttccttgcggtggctgtatttcttgatttgcttattaaaggattcaatcaagttcgtagaataaatactcttgcgtatggccaaggggaaatcatagaaagtgagcaagtgatcgttcgaaagaatcgattcaaccacttttggatagctggttttccattttttcgcaaaagcaccacgtgcttccaacgccacctctttagacgaggcttgatacaccattttaaaatcatcacagacttccttacgattattgacacgcactttgtgactgatattacgggaaacgtgtacacaacaatgttgaaaacgagctttgggatagaaccgactaatcgctcctaccatcccctttaagccatccgtgatgaacaggaggacatttttcaaaccgcgctcttgaaggtccaataaaatttcctcccaaatcgtgatggattcagtcggtgcaatcgcatagctcaatacttcctttgatccgtccgggcgaatgccaactgcgatatgaatagcttccttggcgacggttttccgctttaacggaatatacgttgcgtccatataaatagcagcataactgtcatgaagctcccgccctttaaacgccgttacctcttctgtaaatgattttgttatattggacatggtttggggcgtgtagtgatgcccatacattttctcaatcaagtctgcgatttccgacatggtaataccttttcggaagaggtgaatgacggtctcctctaaggtatcattcgtccgtctataagcgggaacagtctgttgcttgaactcgccgttgcggtcgcgcggaatctggagatgaagttccccgtactcggtcttgaccgtacggtcataggagccgttacgagaattacccgtgttaaaaccaatgcgatcgtacttttcgtaatcgaggaaagccgttaactccattttgagaagcgtattgacagctttttccaaatggacacggaataattcattcaaatcgcctttgttcgctagagtctttagaatttctgtagtaaaatcgttcatatggaagtcctcttttctgtgaatgtgttgtggtaactctattctacagaagggacttccttttttctatttacacaaaatattttacactctcgggagatttccaatgaagaaaaaaacatttaaaaaactattgtttctaggaggtacagctactcttttattaagtggtacaagttattacctacatatccattctccagaacatacaatgaatactacacaaaaaagttcaacacaaaaaacgaaaaaaacaaaagagaaagcagaagttttgctagatgttccattagagagccagtttgactctccttctctagaaaatggctgcgaggtcacttcgctttccatgcttttatctttttatggttatgaaacgactaaaaaccagttagctgaacaattggattacgtccctgttttcaatgcagatgggactcatggcgatcctaatgaaggatttgttggagatatcagtggcggagactgggctatgggcgtctatgtccctcctattgcctctcttgctcaacagatcgtccaaacggattatcatactttaccaaaaacagatgctcaactagatgatatcaaaaaagctctatctaaaggaaatcctgtatggacttccgtgactatcaattttgaagtccctgatgaaactgattttatgacttggacaacaaacaacggagaagtaagagtcactccacttgttcatgcttgtgtagtcactggatacgacaaagagaatatttacgtcaacgacccctatggcgtaaaaaatcgagcagtaccgatcaatgatttttcggccattttcactgcaatgggcggacaaatgctaactttggagaaaagctagtaattaaagtaaaaatcccttatactctagataccgaacctttgaagggagcacagataatggaaaaattcactcataaaaaaatggatccaaatgaaattccgattatttttgtccgtgatcgcaaaggaaatgttcaaggtaaagtttctattaatgagtggaacgaacggcgcagacctgctaccctcaatgaactagaaatcaaactgtatcgtcaagctcttgtctattatggagaccaagagtatggaaaagcaatagatttattaaaatttctaatcgctcgaacagagtacacccactttgaatatatcgagcgtttagcaaacatttaccatatcatgaatgaacctgtcaaagaatatcagttgcttgactccgtcttgtcagtagcagagcggattgcccttcctgctggactggaaaagaaactggtgcgtcgccttttacgagtaaaacaacaactatctgatcaagaaaaataacttgcgtttttttagaaaagtgctatgattattttgttgaataaatgggatgtagccaaactggtaaggcacttgactctgaatcaagcaattgtaggttcgaaccctgccatcccaatttgatgagcttgttgataagaaatgaacccctgaaaaaagaatgatcttttttcaggggattttggaatatttttattatttattatttagtttacataattttattataatcaacaattaaatctgtagcactcatacagtagatttagccaataattgctaatgctttttccggaactttttctctaggaacttcttcatacgtttctatgtgtgctcctttattgctgattttcaaataatgattttcttttaacacagaaagtccattaaattcaattgttcgttcttccccatcggcattagcagctttttgaacataccttgccgttccatgttcatttacttcctctggtttttgtgtttttacatagacctcacctttttcaactaatggatttagttggtcaagtataccagggatttccccgtaacttctttcagtatagtatttcagtccaaatagcaaaataccactaatcgccgccaatcctatcaaatatttaatcactttcatctttctacctccttgttatatatccagtatatggggcaattagagaaattccatccgtcctaagttggagatttttctcctactttagaagcgagaaacaagtgtttttttagcaaaaatgatcgttatttgatattatggtgatgtggataatttagattttctcgctttatccatggaaaaaaatcaagttgatggcaaaggatgtgttcaaaatgaatcaagaagaattatttcaaaaagtcaaggaaatgataaaaggcggcaacttcgacggcgcaaaacgatttatcgaagaacataaagaacaactaggtccttacaaagagaaagcacaaaatcttctaaaagacgtaaatatcgacagtgtgaaagacaagttcaaaaatctatttaataagtaggaattttcatttctggaacaccgtttgtccagaagaagggactgtgacacgacttttgtcacagtcccttgtttttcctgaatcatccttactaaaataagcgtgtcggatcatagtgataagtcacattgccgttcagcgatgcttttcctaccacatatttacgattctccaatttcagccatgcttctcgaaaagccatcaattcttctctttttacatcgattttttcgatttttccatcaatcaaatcttggataagttgttcatatggattcatttttttcctccatttactgttaatcaataagttgtaaaaataggttcatatgcctttttagtatccagatcttctctgactttgactgtcgtataaataattttttctactgggatactataataactaccttcaccgttattgaatcggtgaacgtctttctttgctaaaataccattgattttattcgtcagtacacgttgttcgacactattgcttacaacatagtaaatcacccgaatattattgattaaatgcaaatcgatttctaacactacatgatccatgaaaattccactccttctttcactttgattatagcaattttcccctataaattcaaaatcaatacatattttactggataaatccatagaattgcttgcgccttcacgcacaaagtgttattttgtatcttggactttatttattggaggcaatagtatgatcgcgatcggtcagttagttttttatattcctttttttattatgctaagcattcttttctattacataaaatggacgaaaaagaagttttcagttttactggcctctttacctgccgtatattttacttatcagattttttcttttagacattgggaaacaacatctgtattagtgatacacatcatcgaattgacgcttgcagtagtttttctaatcatttggatctattttttatatatgatttgtcaaattaagctagaataaaatgcttcttgtacatagctcaaaaataataagaactacctgattagggtagttcttaataagagaaatatcagataaatttgtacaagtcataaaaaaattagtcttaaatttttaaatatataccttgtttattagatactacttaatttaggtagtacaaaattaacagataaaactacatgcatgtagtttgactagctaatgagttgcatatgatttatataaaggtgtgcagcataacttagttgaagttaagagaatagaataaatattttttgtttttctaataattaaacactaccatatttaggtagtgtttaattatatattattattttttttaaaagaattttattatataagcataacaagtgtgacaactattttttcagattatttaagtactacttaaataaggtagtacttaaatttcggtttaaggtagtaggtaattaagaaataatatatatcttcttttataatagaaggggagaggcatagttaaaagcagcgacaattaataacaatgtatttaatgcttcacaaaatccatttgatggacaatcgatcgatattagcaatgatgatctactgttctaaatagtttttctattggttgcatttgctacggtttatgttataatttagttaacaaaaagaattttcaatctataaccaaaaaccactagctggcgggctagtggttttcttttacgtttctattataagaattaacgggtaggcttactgtctttcttggcaaatttacaatcaagccatttgcagatatagtgcgcggctacttctgctatgattgcaaaaacaaaatcaaaaagaattttcaaacctataacctcctccccttgccagattaggccggggtagcagacagcaagactattatagcataactgaaatatctaaatgacgtatacagatatgataatttatgtagtgatttttctaacaaaagcacattttttaatatatactacctaaaataggtagtatatatttttatatacaatatcgatcagttttgaggaaatgaaattctggatattttttgctacatagagttactttcaatattttttaacgtaattaggcagaagtcgctcatcttctataggttggtgatgaaattgcgattgatccatataagggagaacaaaaaactggagatttatcaggtatttggtctaatggatttaagtatgcggtcaccgtgtagagagttgcttatgagattcaagaaaataaagttattccaatattgttatatagaatacataacaatttttatgaacaattgaaaaaataaccgagtgatttgaggtcgttctgaagaacgacggcttcttttttatgaattagccgagaacactcgcaactttattcgtgtagatgaatcggcttcgattgagttataactttatctatatcaatcaaccgacatatgttaaatctatatatattgaacctctcatgactgaagtcacgagattcttgggaaaagagcatacttggtagcgtatgtctttactaacagcggtgtctcttatttaccaagctatccccgtagttcctacggttcttgattattcctaagctaatgcttgtattcgtaaaccttcggtcaaaatatttatactagcgttgatgtctcgatcgtggtgcgtatggcaaataggacaagtccattctcgaattttgagtgacttcttgccgtctctgtgtccacattctgaacaaatttgactagacggaaaccatttatctatcttgatgattttgcgcccgtgccagtcagctttgtattgtaatttagtcacaaaacttgaccaagaaacatcagaaatgctttttgctaatttatgattacgcaacatactttttgtgtttaagtcttccatacagataatatcgtgatttttgatcatttctgtactcaacttattcagaaaatcagtacgttgattcattactttttcgtgcaatctagccactttacgtttttgtttttgataatttttagcttcaaatagattgatacctttctgtttagctaataatgtacgtctagacaacttgcgttgttcacgtttaagtttcttttgcattttggccgtgaatttattattatcaattttttgaccatcagaaagaatcgcaaagtcagtaatacccaagtcaataccaatcgcagaagtggttttaggatattccataatttcttcttcacaaaggatagaaacaaagaatttaccacttgaattttttcgaatagtagcatttaagattcgccctttgggttctcgactcttagcaaacttaacaagtcctaacttaggtaatttcacgaagttatttctaatttggatactattattcacatttttagttgtatagctttgaataggattctttttacttttaaattgtggccgtctattttgctttctaaagaaccgagaaaaagaatcagaaagatttttcaatgatgattgaatcgcaatgctgtcaatttcctttaaccaaattgtctctggatttcttttcatttgtggaagaatggcagagcaagaatgataagataatccttttccagtagtcgtgtattcgtgattccacaaattcaaaaaatgattatagatgaatcttgaacaaccaatagttttggcaattaatatttcttgttcttgattaggatagattctaaatttataagctttatgttgtagcatatggattcacctcatttctttttctggttttgtatatattttctaatttgttcttctgtattttcgctaaccgtggctacaaagtagctgggattccaaagatgtccaccccaaagccgttgtttaatttcaggatgttttttaaataggaatctagcggatacacctttgaatgctttaacaatactgggaatatagtgttgtggggtacattcaataagtaaatggatatggtctttgactgattccatttccataatttttacattattatcatcagcgatttgtttcaataactgtttaacatcaatgtctacatgaccatacaaaatatcatgtcggtattttacacaccaaacaagatgatactgaatagaataggcgtagccacgtccataatatatagatttaacatatgtcggttgattgatatagctaaggctatacctcaaccgaagccgattcatctgcacgactaaagtcgcgagtattctcggctttttgataaaaatacctacttaaatggatgttaacggaagtgtatggcgagtagttcactcgtattttgatatcgtttgtatatgttttcagcgttctaagtggcttattttgtccaataataatatggagtgggagtccttaagcagcaccgttggcgatcgtcgttataacatgttataatttgtttgtcaaaagctaaaaggagcgtgataacatgggaaaagaactaaaggttagaaagatcggcaatagcgtgggagtgatccttccaagctctcttggattaaaaaacggagacactatccaagccaaacaagaaggcaacttattcatattagataccactcaaatagcaaaagaacacgatcgcaaattaattgaagaaagtttccaagattttgagaaaggtttaacagcttcagaaattgaaatggtaaaagctttcggaaaatacggctggagttaatagatggaagagtacacgctagtttattttaaaagtttccagaccagccttgaaacgataatagaaggctgggaaaatgagcttgctctttccccagccagcataaaaagatttgtaggtgcgatccagaaggctttagaactaaccaaaaattttccaactatgcatgaggaagtttccgaaatctatggaatggatatcccaacatatcggatcgcgatcggaaaaagctatgccttattttatcggattgaccatgagaaaaaaaagatacttgtaggacgtattttccaatctaaacaaatgaaactagacctttgagaggtcttagggtgctgtggaagatactctaagggtttcttttgctgattttatgaaaatggcttaaaaaaataccttaatataacgatatggttattttaaaaaaaggaatttcacaaactttcaaaaatcaaaaagcagggaatttcagtcggttttacctagaccaattttatttcacaaagttagctgaaaaaagcttgggagagctggtacttgggatagtaacgattatgtaaactagcattataaataacaaagatgggatgttttttattttggaaaacactaagttgattattttaggaaatgggtttgatttagcatgtgggttaaaatctaagtatgctgatttttttgaagaccgtatatctgaagatttaagtaattgcttgaagagagcatatcaaaggttttcatttgattttgatgatgaaactattgatgctccagtttatcgatttcaaacaatttatgatattagaaagaaatatgttaggagattagaagatgagaaaccttttaacataagaattctatcactttctcaatctgatatagagattttaaaaaaaagtaaattgactttttgggatattgttcttttttattttcagaaaaatgatgatgagagaattgaagatgtagattggaaagatattgaaaacagaatgttagattttttaaaatatgaagaatctggtaaaccaagtttaacgaatatattagaagtatagtataacgaaaatttggtttattttaacagtaatgaggttaaaaaggctggctgctaaatgacaacaattaaagaattttttttaaacaatggtatcggttaaatcgcatccttaagtctttaagcaatttaagattgttagtgtaacttgttacttaaaatgtaacaagttttctttaaataattttgatttctaaagttttaaatccgctttcataaatctcaaaagacgcttattctaaatatgtcagatatattactcgagtaaaagacagattaattaaaaatttcgaaggagcgttaattatgcagaaaagagattttatcgatacaaatgattttacaaaagaagaaatcgattacttgatcaaattaggattaaaaatcaaaaaaagtattaagtatggtcattacccattactacttaaaaataaaacactaggaatgatttttgaacaatcttccactcgaacccgtgtttcctttgaaaccgcaatggaacaattaggaggacacgcccaatatttagcacctggtcaaatacaactaggaggacatgaaagtcttggtgatactgcacgagtattatcacgtttagtagatatattaatggctcgagttgaacgtcatgaatcagtggtttcgttggcaaagaacgcaacaattccagttattaatggcatgagtgattacaaccatcctacgcaagaactaggcgatattattacgatgactgaacatttaccaaaaggaaaaaaattatctgattgtaaaattgtttttgttggagatgcaacgcaagtttgtgtatctaccatgtttatggcaacaaaaatgggaatggattttgttcaatacgggccagagggattccaaattaaagaagaagcattagaaatagggaaggaaaatgcaaaaaaatcaggaggaagcgtgcagatcacagaagatgttaatgtggctcttaaagatgcggactttgtctatacggatgtgtggtatggcttatatgaagcggaattatctgaagaagaacggatgaatattttctatccaacctaccaagtaaataatgaattgatgaaaaaagcttcaccacatgcaaaatttttgcactgcttaccagcaacacgcggcgaagaagttacagatgaagtgttagatggtgaacaatctatcgtattagatgaagcagaaaatcgattaacagctatgcgggctttattagtttattttttgaatccatatttggattatgccgatcaagctttagcagaaaaatttgatggggaattgcaatgtatgctgaaacctaaacgtcaattagaacgaagagattagcaagaacttgcttaagcagtagaagagtcgtgtaaatcttttactaattcatagagagtaaaaaatttacacgtacttttcataaaaggctcatcgaaaggagcacaataatgaaagaaaaaaagagattccgtttatttgatgcagtattgatggccgttgtagttatcttagtagtagagtcggcagcaccagctgctgcaatcggctcttcgcaatttttttggtggggtttattattgatattatatttcttaccttacggattaatatcagctgaacttggcacgacatatgacggcgaaggagggatttatgactgggttaaaaaagcttatggaagaaagtggggtgctagagtcgcttggttttactggattaattttcctatttggatggcgagtcttgccgttttatttcaagaagtattaactcaaatttttcaattaaattttagtacacctctactgattatgttgcagttggtatttgtctggattgttacgataattagctgttaccctgttagtgatagtaagtggatcttaaatatcgctgcatttgcgaaagtggcaatcatgatatgtcttggtgttttaggtatctatcatgcattaacaaaaggaatggctaataacttttctggaacagctttgttacctaaactagatattcaaaattttagttttttatctgttatcttgtttaattttttaggatttgaagtggtcactactctagcaaatgaaatggataactctaaaaaacaaattccacaagctattatttatggtggtgttttgatcgcctttttctatttgtttgctgcatttggaatgggagcggcggtaccagcagatcaattatctgcttctggaggattaattgacagctttattttgcttgttgggggattgaatccttttgttgtattaatcggtattctcttcatgtatacgctggcagcaaacttgatttcttggtccttaggagtaaattatgtcgctttgtatgctgcgaaaaatcatgatatgcctctaattttcgcaaaaaaaagtcaaaagaatgatatgccagtaggagcttctgtcattaatggtattattgcttcacttctaattgttattgcaccctttatcccaaatgagaatattttttgggcatttttctcactaaatgtagtagcgttgttactttcttatattatgatgtttccagcattcttgaagttaagaaaaatcgattctcatgttgttcgtccatttaaagtttctggacccaattggttgttaaaattaatgacgattatcccaatgttgttgctaatcgcgacactgcttttttctgtagttcctctagattcgagttcttcagagataaatactaaaatacccgtgttgctcggaacaatttttgcctttgttattggtgaaatcgtgattcactattcgtcaaaagaaaaaaaagataagggagtgcttactgatgaaaacaattgatagttcacctaaaaaagatcattttagaatgcccggagaattttcggtgcatgaaggagtatatatgttgtggccacaacgtcctgataattggcgagatggaggaaaaccagcccagcgagctttcgtagaggttgctagagcgattgccaattttgaacctgttacaatgggcgtgaattcggatcaatatgataatgctcgccacatgcttcccgaacatatacgggtggtagaaattgctagtaatgattcatgggttcgagattgtggtcctacttttgttacaaatagtcaaggaaaagttcgaggtgtggattggacattcaatgcttggggcgggctggaagatggactttattttccttgggatcaagatgatcaagttgcacaaaaaatttgtgaaattgaatggaaggaccgttatcgtttagataattttgttttggaagggggatctatccatgttgatggagaaggtacattaattaccacagaagagtgcttattatcaaaaggacgcaatccacagctatcaaaagaacaaattgaaaatattctaggagagtatctaaatattgagaaggtaatttggttaaagcacggaatttatttagatgaaacgaatggccatgtagataatattgttaattttgtagcacctggtgaagtcgttttagcttggacagatgataagcaggatccacaatatgaaatttctaaagagtgtctagaaattctggaaaactccgtagatgcaaaaggtcgaaatattcatgtaacaaaattgcatgtgcctaagcctatactgattaacgaaaaagaaagtcatggagtagatactataaatggtacactcccacgtcaaaaaggagatcgtttagcggcaagttatgtaaattactatacagccaatggaggagttatttatccattatttgatgatccaatggacgaaaaggcaaaggaaacattgcaatccttatatcctgatcgtaaaattgtgggtgtttatgctcgagagatcttattaggtggaggaaatattcattgtatcacgcaacaaatccctaaaggagaaaacgtgttatgacaaagaaaatagttgtggcattagggggtaatgcaatattaacaaatgatcctacggccataggacaacaaaagactttagctgaaacagctcagtcattagctgctctagttgaaaaaggctacaagctacttattactcatggtaacgggcctcaagtaggtaacttattattacaacgcgaattgtaaaattaagttagaaaaataaaaaggcatttatggtacactcaaattgttttcctttaattttgatgtacgtttcatccattttccatgaataaaaggatttttctttgcaacagaaccaaaaaaatgccttgaaagtttctgagaaaaaaagtgtgaaactagacgaaacaatagaagcgaaaaagaagttaattaatgatggaaacgagtttggaaaagtaacgttttattatttcggaccttttgcttatactgagcacgatgccttgtttatctccagtatgaaacaaagtttaatgtatgttgctattgcagctcttcttgtatcatttatacttgcttcgtggatctctgctagattaggattaccactaaagcatgtaagcgactttacacataaattaacccgtggggaatatgctgataaaatcccacaagaaacttcaattattgaaattaattccttgattgattccctaaatgatttaagtaatcagttggagaaacagcatggacttcgaaaaagattaactactgatatttcacatgaattaagaactccattagctacccttaaaggcaatgtggaaggaatgattgacggagtctggaaaataactcccgagcgcctacaatcttgttatgatgaaatagatcgtctaactcgtttaattggaaatatagaagtaatcaacaaaattgaagcaaaatatgatcatttaaataaaactgagtttaacatatataagttgattgaatccgttattgaaaatttcgccagcaaaattgagtcaaaaaaccttcatgttgaaatccaaggggataacatcaatatatctgcagataaagataaaatgaaccaagttgttatcaatcttttgaataatgctattaaatttacgcaaaaggagggaaccattaagttttctataagtaaaaataaagaccatgttcttttaattgttgaagacaacggcatcggtatagaaaaagatcagcaacttcatatttttgatagattttatatggctgacccctccagaagtagagctttaggggggcaaggtatcggattagctattgtaaagagcgttattgaagcgcataaaggtagtataactgtaaaaagtaaattaggtctaggaactaaatttgttataaagttaccatttcaataaaggaggagagttatttgtttcaaaaacagataaaaattgctaaactagtatgtgaatgttgggcaaaaaaatattttttcaactgatttcgatagatagtgtcgaaaaagttcatttagatatcttatcaaattctgtagtaatcttttctaagaaggacttatcaatagctacaattaaaaaagaagtttttggattacaaatttatgagatgacctaaatgtgattaattaaaggaggatgaagacagtgaaaaagatgacaaaattagtatttgcaagtcttggaattattgtatttttaggagcgtgtagcaatcaaagtgaatcgaataattctaaaagcacaaacgaggaatcgacttctacagcgtctagtgaaatgaatagtatggagggaatgaatcacgaaggtatggttccttcttcaatgaaagatgctgcgaaccctaaattcccggtgggaagtaatgttatactgctgggcgatcatatggaggggatgaaaggtgcaaatgctcaagttgtaggggcctttgatactacaatgtatgaagtaagctatgagccaaaaactgggggaccaatggttaacaatcatcgatgggtagtacaagaagagttaaaagatactgagactgtagcaaatgagggcgatactgttatcttgaatgccgatcacatggatgggatgatgggagctgaagcaaaagtagataaatctattacaggaactgtttacgttgttaattacactccaaccgatggtcaagaagaagttaagaatcatatgtgggtaactgaagatgagatggaatatgacgaaaataatgagtaattttatatactaaaccaataagctggtacatggccttcgtattctcaacatgaggaatatgagctctttgttaataaggactgatgagttgtgcaaaatcaaatctgggtcagaacgaacctcattctggctcagatttttggctcttcgacatttagtgctggtagagagacaactgaaaatttagtcataaccagttaggcagagtgcttaactggtttttgttttacttggaagatcaagccttgaatgagataaattcttgctcgaaagttgtggaaatttcgatagccgtaggatactcgttttatcacttttatcttattatttgttctttccaatgcaccattactatacctgggttttaaagcatattgaatccctaatttgtatttatttaaaaacgtcagcttcttacaaaaccattgtggaaggcattgatctaagctgttgatcgtatcgaaaaaactttggttgtccttgtgtttaaagtgatagaggaggagctggcaagtctcgtaagccctggttaattgctcgtcgtaactcaaaagctcatcgaccatcgctttttgcgtcattggtctgcgaaaggatcgatcatattgataatcggaactatccagatcataggcatgcgtaaggagtaatttccagaatcgcttcaatcgtcaatactttgtcggttccgttttttgaaacctgttcattgttttgattcgcaactgatttaacgtacgagtgatttgttggacaatgtgaaagcgatcggtcacgattttggcgtttgggaagaccgcttttacaagttcaaaataaggggcattcatatccatcacgacgtatttcacgttcgctcgtgcttttctagtgaatttaaggaaatatggttttaagaaagcaaggcgacgattctccaatacaccgattaattgctgggtctgcccattcataaaaacaaaactcatttttccactgcaggacttcatcgatttgaactcatcaaaacaaaggaccgaaggtaacgtatcaaaacgaggatgatacgtttttaaacaggtgtgcaggacacgcagaacggttacgtcagagacaaaatagcgatcggcaatttcttttcttgttgtattcttcgccagctccaaggcaatttgtacctttaattcctttgagagatagcagttttcatctaccaaattggtctgagcgttgaatgtcgactgacattctttacagtaaaagcgcgtacgtaccaagcgtaattctgttttggttgctcgataaggcaaaagttggacttttgttttatgtgagccattcttgatgatttgtccttcatttttgatgccacatttacggcaatggcttagtatatagctaagtttagcatggataagattggtgcgaaaaccatcttcttctactgtctctaaccattcttcttcgaagaataaattttcatctgttaaacctaacaattttctagtacaatgatacatggagatatcctttcttggtatggttttgttttagacgactaaattccaccagttaggctatctctttttctatctttttttacaaaaaaagtgtcagtagaaaatctgtagattttccaccaacactaaatattgtagaatcaaaaatcagaactacatccagtagttctgatttttggttctcttattgtatgcctagtatttaagactctgattcaaattttgaaaaaggaaaattactattataattaaaagcgtcacttttgtatattacaaatactaactattatcggttctgttgcaaagttttccaaaaaatctattttagtgtaaaattgagaaaaacaatttgagtgtaccataaatgcctttttatttttctaacttaattttacaattcgcgtattcaaaaaaaatagcacaatggcaaagatcataagagagatcataaaccccaatgaatgactaaaaagaaaagcagaatcacatgccatatcatccaatatttcttcaagaaaataaataagcgggaaaaagggaaggaatagtagaacatcgatccagcaccatttttttcttcttttgaaataacataaaacaataaacatgaacgtgcagggaagtaaaaacaaagctttactcataactaacaaaataccagctccttttatttttttctcccccacattcaaagagtcacaatggtatgtacttaataatagaaaaatggatcaacttgtatgaatatcagctgaaaagatctgcaccaaataaaaaacttccagccaaaactgactggaagtttatttttttctgaaatattctaacacaaatatgaaaaagatggccgaagctaataagccgatttcgtagcaaaacaatgagctaccagagtcgtaataataaaatcctctaatcttatgaataaaatagatcatcggacaagcagataagagtaagtatttattaggccttttgaataagtaaaagaaagcactggtcattatgataaatggtgtccaaaacaaaagtttacttaagacaatcaaatgatcaactcccatattttttaccaagagagatcataacatctttatcgtaaaaacaaaatatttttttgctcattttgaaaatttaaacatactcgttcttatccaaatatataaaaatcgcccctcatccatcgagaggcgataagttctaatttaactcaattttttttgtttcttttggctgatgagctgttttaggtaatactaatttcagcacaccgtttttaaaggttccagtgattttttcttcatcaacattaggaagatagaatgaacgtttgtaagagaccgaatgtctttctttccgtacatagttgccatcttctttatcttctgtatgggactcatgattggcggagatcgtcaaagtattatctgaatattcaactgtcgtgtcttctttgtcatagccaggcatatcagcagttagtttgtattctttttcattttcgactaaatccacttttggataacttgaaacacctaaaaaatcattgaatgctggactaaacacgtcattgaaatcagggaacatgtcgcgaatgctaggtacatttgccatttttaatcatcctttcaataagtattttttattaataaagttaaaataaagttaatgcaatagcatctaaagttttaattagaattctcctttcttaaatgataaaaaaattatatatcaaaaagagaaacattgcttatataacgcttaggaattttagcaatctatgcaaaaagatgaaaattttttttgctcttccattagtacacattttttagctgaagctgtaaatttcatgtcttaatttttttagtgagcttttatactggatttgtaagaaaaaagaaggagaggatcacatatgtcggattggttggatattgtaggtggatttgagtcaatatcttggacacattttagtagagacggttaagccattttttcttttgctaattcttcaaattcctgtggggttagatagtgaatcgagctatggattcgatttcggttataaaatccttcaatgtagctaagtagcgctcgatttgcttcttcaaaatctgagtatctagtcgtgtagacttcttcttttttcaatgaggcatggaaagattcgattccagcattatcataaggtgttccttttctactataagaatgccttattttgttggttttaagccattgttccacttctcttgctgtgtattggctgcccaagtcagtgtgtagaatcattccttctggaatgtgataatgtatttttgctttattcaatgtttgaatgatacaatccacagtcattcgttttgaaaatgtataactaataatttttttcgtgtgtaaatccatgattgaagataagtaacaccaaccatttttcttagtaggaatgtacgtaatgtcagctgcccatttctcacagatcgtttcagtagaaaagtcctgatttaagagattctcttttgaaatgatcggtttattagacctttgaggtctatattttttaactacaatcgaccttaaatttaattgtttcattagcttttggacatgtttaagagatactgaaatcccttcttttaataaaacttgatggatctttgtggcaccatagcgttgtttattcgtaaaaaaaattgttgaaatcttctttttcaacttattatttctgatttctgtagctgtcaacggtttattcttataaaaataatagacacttctagggatttctaataaccgacacaacaaagaaacagtgtaatccttacaccatttttcaataaattgaacaagcgaatttaggttttccgagagaatatggctgcggctttttttaagatttcaagttcctcatttaaacgagcattttcttttctcagttcagctacttcttttccagtcagtcctgtggactgatcaggtaaatataaattcttccatttgtaaatcgttgcttcagataagccatattctttcgctaacccttgaacagaacgtccagtttgattcagttcaacaatcatttgtttaaaattttcttcatatcgggtcataaaaattcatcctctcgtagataagtttaatttattcttgtctctacgaaaagctgtctaagatttgatactaacaccaggaataaaaggtgatagtggtgtgggaaagtcaactttagcacaacttctagctggattttatgtaccagatagcgggaaaatttgtataaatgagaaaaatattgaaaatattaatagaaaagacttacgtaaattaattacttatgttcctcaagaatcttttattgtgagtggatccattaaagataatttagttttaggtttagaaagtgtccctaatgaaaaagaatttgataaagtattgaaagatacttgtttgtggagttttattaatgagcttcctctgggtcttgatacgtatctagaagaaaatagaacgaatttatcaggtggtcaaaagcaaagaatagctctagcaagagttttattatcagaaagtaaagttttattgttagatgaagctacgagtgctctagattctaaaactgaaatgcgaatttttgataagttattaacatactctaataagacattaataatgatatcccataaccttaacttaataaacaagtgcgatttgatagggagcgtcaataattttgtgtaaatggaaaagcccattctgttgatcaagttaaaacattgattctaatgtctaagaagcttaacttctgtgttcggcatggttacaggtgtatccttctcgctatcgccaccacactgtggtgttatcttttattgagtaaattttgttcactcaaaactggatttgaagtcatataagtttttttccgagttcttttcttttaaccaattggttaagtcctcgatcgattagtatcagtccgctccatacatcactgtacttccactcctgacctatctacctgatcatctctcagggatcttactttcttaaagaaatgggaaatctcatcttgaggtgggcttcacacttagatgctttcagcgtttatcccttccctacatagctacccagcaatgcccttggcagaacaactggtacaccagcggtaagtccatcccggtcctctcgtactaaggacagctcctctcaaatttccaacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgacttgttggtctcgcagtcaagctcccttctgcctttacactcttcgaatgatttccaaccattctgagggaacctttgggcgcctccgttaccttttaggaggcgaccgccccagtcaaactgcccatctgacactgtctcccaccacgatcagtggtgcgggttagagtggccataacgcaggggtagtatcccaccagcgcctccatcgaaactagcgttccgatttctacggctcctacctatcctgtacatgcggtacagacactcaatatcaaactacagtaaagctccatggggtctttccgtcctgtcgcgggtaacctgcatcttcacaggtactaaaatttcaccgagtctctcgttgagacagtgcccaaatcgttacgcctttcgtgcgggtcggaacttacccgacaaggaatttcgctaccttaggaccgttatagttacggccgccgtttactggggcttcaattcgtaccttcgcttgcgctaagcactcctcttaaccttccagcaccgggcaggcgtcagcccctatacttcatcttacgattttgcagagacctgtgtttttgataaacagtcgcttgggcctattcactgcggctgatcgtatgatcagcaccccttctcccgaagttacggggtcattttgccgagttccttaacgagagttctctcgctcaccttaggattctctcctcgactacctgtgtcggtttgcggtacgggccgctgttttctcactagaagcttttctcggcagtgtgacatcaggaacttcggtactattatttccctccccatcacagcttgtccttaagaaaagaagcatttgactcctcttcagacttactgcttggacagacatttccgatcgtctgcattccttagcctcctgcgtccctccattgctcaaacaaaaacaacgggtacaggaatatcaacctgttatccatcgcctacgcctatcggcctcggcttaggtcccgactaaccctgggcggacgagccttccccaggaaaccttagtcattcggtggacaggattctcacctgtctttcgctactcataccggcattctcacttctaagcgctccagcagtcctcacgatctgccttcgacgcccttagaacgctctcctaccaatacacctaaaggtgtactccacagcttcggtaatatgtttagccccggtacattttcggcgcagggtcactcgactagtgagctattacgcactctttaaatggtggctgcttctaagccaacatcctagttgtctgtgcaaccccacatccttttccacttaacatatattttgggaccttagctggtggtctgggctgtttccctttcgactatggatcttatcactcacagtctgactcccggatatgaatgaatggcattcggagtttatctgaattcggtaacccgagatgggcccctagtccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacgactacatactcaaacgccctattcagactcgctttcgctgcggctccgtctcttcaacttaacctcgcatgcaatcgtaactcgccggttcattctacaaaaggcacgccatcacccattaacgggctttgacttgttgtaggcacacggtttcaggttctatttcactccccttccggggtgcttttcacctttccctcacggtactggttcactatcggtcactagggagtatttagccttgggagatggtcctcccggattccgacggaatttctcgtgttccgccgtactcaggatcctcctaggtgtcttccacatttcgtctacggggtttttaccctctttgactgacttttccaagtcattcgactatctgaaagaacgaccatattggagtcctacaaccccaacaagcaagcttgttggtttgggcttttcccgtttcgctcgccgctactcagggaatcgaattttctttctcttcctgcaggtacttagatgtttcagttctctgcgtctacctcgaatgtgctatgtattcacacaatcgtaacatcctattaaagatgctgggttcccccattcggaaatctctggatcatagcttacgtacagctccccaaagcatatcggtgttagtcccgtccttcatcggctcctagtgccaaggcatccaccgtgcgcccttattcacttaaccttatcaaccttgcggttgggttttgatccttcttctagcgatagaagttagatcaagaaaataagcaattgaacttattaaaaaactccgttcatatggaagtcctcttttctgtgaatgtgttgtggtaactctattctacagaagggacttccttttttctatttacacaaaatattttacactctcctacttgaagtttccgaatgaaaactctataatgagaaatgtgaaaatgttcacttattgtaaattaagtttggaggcttttatttatgaaaattgcaattgcaggggccggcgcgatgggttcccggttcggactgatgttgaaacaaggtggtaacgatgttttgctaatcgacggctggcaggagcatatcaatgccatcaaagaaaacggattgaaggctaattataatggcgaagaaattactgttaaagtcccaattgttaatcagaatgaggtgcccattggtgagcaatttgatttgattatcttattcacgaaggcaatgcagttggaaaaaatgctgcaggatgttaaaccattaattgctgatcacacagaagttttgtgtcttttaaacggtatcggtcatgaagacgtaatcgaaaaattcgtaccgatggaaaaaatctttatcggcaacaccatgtggactgctggtctagaaggtcccggcaaggctaaattatttggcagcgggtctgttgaattgcaaaatctaggtattggccaagaagaatcagcgaaaaaattggcggaaactttgtccgcgtctggtttaaatgccaaatattccgacaacattcattattcaatttatcgtaaagcttgtgtcaatggtacgatgaatggcttatgcacgattttagacgtcaatatggcggggcttggtgcaaccaaacctgctcatgacatggtagtgactattgttaacgaatttgcagctgttgctgccaaagaaaacgtcaacttagacattcccgaagtaatcgaacatgtagaaacttgttttgacccgactacgattggtatgcatttcccatcgatgcaccaagacttgataaaaaataaccgtttgaccgagattgactacatcaacggagccatttctcgtaaaggtaaaaaatatggcgtagtaactccttactgtgatttcttaacgcaactggttcatagtaaagaagaaattctaggagcgaaatagtaatcattagaaagaggacgagaaaatggaagaaaaattaactccaaaaatatttttaaataaagtattagcgggtaccgcaacggggatcatcgtagggttgattcctaacgcggtattggcagcaattttgaaattatttggtgaaaataccttagcagtaacgatcacacaaatggcagttattttccaactagctactccactattgattggcgctttgattgcggtgcagtttggcttcaaaccaatgcaaatgttagtagttgccggtgcagctttcgttggctccggtgttgtgaaattcaatcctgacacagctacttatatcggtgctggtaccggagacatcatcaataccatgattactgcatcaatcgctgtcggcatgatcttgttgatcggcgaaaaatttgggtccgtggcaattgttgcaacaccaatcgttgttggtatcggcgctggtctaatcggctattatttatatccttacgtaaccaagattactgccgctatcggtgacttaattaatacctttactactttgcaaccaattttgatgtcaatcttgattgcatgttcctttgctttcttgattatctcgccgatctctacagttgccattggtatggcaattcaattgaacggtgtttctgctggtgcagccgctatgggtgttgccgcaacaacagttgtcttggtagttaactcttggaaagtcaacaaaccaggggttactttggccatcgcattgggtgctatgaaaatgatgatgccaaacttgtttaggaaaccaattatcttggtgccatgtctattcaccgctatcatctcagcaattccagtagcgttattctcagtctcagggactcctgcttctgctggtttcggtttggtagggttggtaggtccgttggcttcattggacgccggtttgagtattattctactattaatcagctggtttgttgtaccaatcgtagctgctttcgtaggtcaaatcttatttgaaaaaatcttgaaattgtatgatcgtaaagatgttttcgaatttttaggatagtcaactagaaaaagtgtgagccttgtgctcacgcttttttgtgcaattgaagttggtgaatctcagcgaaaagagaggttctgttgcaaagttttaaataaagaataaattcccttacggtatctatgatttaagctgggattcccaataataccttgatttcagacaattgtggtatatgttagaaacagttctcataatttccttgaatgttataaaacctgaataattcatacattctattcgaatgctcacaaatcgcttaacaataatcaaaacactcatttttcattttcacccattaggtgatgaaaaaagaactccgttctgttatggtaaaggtgcttaaaccaaccaaaagaaaggagttcttctaatgactagtttacatgataatcaaatgaaattcaattcaacgatgataatttcacacacaggtggctgcttatccagtgattcagggttagttctaataaaggagttaatggatactcttcaactttcaaaactagcaaagcatttccttcacatagaggacaagcgcaattattatacacatgataacgtggaaatattagaacaacttatcttgcaattgattagtggttattcggctgattcttcagcgaatattttaagacaagaccctgtatttcaagccattttaggtaagaagcaactagcctctcaatcttcactttctcgtttttttgatcgttttatggagaaaaatattcatcaattgcaagcgttaaatcaagcattagtagatcaagtacgtttgattcgcaataacaccgaattagtgattgacattgattccactcactccgatacatttggacgtcaagaacaaacaaattacaatgcacattatcaaacctatggatatcatccgctagttgcctttgatggactaactggtgactttttaaaagcagaactacgtccaggaaatcaatacacctcgaaaggaataaaagcgttcattgaaccattgctatctcattatattgaagcattacctactacagatatactcgtacgtggtgatagtgggtttgcaacaccagaggtgtatgaaccttgcgagaataccaacagtcactacgtcattcgattgaaaaataataacaagttaagccagttggcagaacaatttgttcaatacgatgacaatcaaaaatgggatgaacaagaggtatattatttttcttccttttaccaagcacaatcttggtcaaaacctcgtcgtgtctgcatacgatcggttcgcgagagtggtgaacttctcgttcatcacgcatttattgtgaccaatttatccgaaaatgtctcacctaaagttgtcttctctctttatgaaaaacgcggaacgatggaaaattttatcaaagaagccaaaacgggtctcttttttgacaagacagatagtccacgttttgtagaaaatcatacgagaatgatgataagcgttcttgcttacaaccttgttaattttttaaaaacgattgcattcaaaaaaatagaccaaggaatgactatccagacgattcgtttacattttcttaaaattgctggaaaacttgttcaaacagccagaaaaatataccttaaattatcaagctatcatgtgcaacaaaacgaattctatgcaattttcaggcgcctaaggcggtgccaataaatccttcctaaccttagaaaaaaatgatgaaaaatcaaagaggtggagtctgccaaaaaactgaattgactttcactttaatagcaatagccaagaaaagtagaacaaaaaattaaattttgttagaaatagagagaacgtttaaagaaacgtccgtttttttaaataactattcaaaaaaattaaggctatgaattattcaggataaaagtatctgtataatgttcagtatattttgatgaacgcatatgtagtcctcatttcttgggagttttgagactactatatgcgtttttttgttgatttaccaacatgtttagacattttcctctaggaaaaaattaactagcaccaggggtttattttagtttttcttggaaataaaaacagcgaaaatccgaacattttcacctctctcactttataacttttacaaaatagtacttctcataaaaagcgctctagttaaagaaaataagagaaaaatcaaaaaaaacaaaagtttcttttacacttgtttctatattcgttacaatggttatgggaagtttttcaaaaggttaagaaaagcttacgggggtttttgaaatcaaaaagtagtaggggacgataaaatgaaaggttctgttgcaaagttttaaatctactatcaaataaggtagaataatagaaaaagatagcaggaggaatgacgatgaatcattttaaaggaaagcaatttcagcaggatgtgattattgtagccgtgggctacgtcggcgtacccttcttaccgtcatttcgtccgtttacatcttttccattttgttttctaaatttgacatttatcttcacgtcctttttatttgataatttaagtatagaactttgatatagtttatacaaatagaaacgcttcttcgtgtattctgtgattttcttttgaaatgaggaaaactttggagtaaaatgaacgtggacagaacaatatttaggaggaataaactatgtgtacgtctattacttatgtaacaagtgatcattattttggaaggaattttgattatgaaatatcttacaatgaagtagtcactgttactccaagaaattataagttgaattttcgaaaggtaaatgatttggatactcattatgcaatgattggtattgccgctggtatagctgactaccctctttattacgatgcgacaaatgaaaaaggattgagtatggctgggctaaatttttctgggtatgctgattataaagaaatacaagaagggaaagacaatgtatctccttttgaatttattccttggattttaggacaatgctcaacagtaggagaagctaaaaaattgttaaaaaatatcaatttagcaaatataaattatagtgatgaacttcctttatcccctttacattggctattagctgataaagaaaaatcaattgtcattgaaagtatgaaagatggacttcatatatatgataaccctgtgggcgttcttaccaataatccttcatttgactatcaattatttaatttaaacaattatcgtgtcttatcgagtgaaactcctaaaaataatttttcaaatcaaataagtttgaatgcctatagccgcggtatgggagggataggcttgcctggagatttatcctcagtatctcgttttgttaaagcgacttttacgaagctgaattctgtatctggagattcagagtcagaaagtattagtcaatttttccatatcttaggttcagtagaacaacaaaaaggtttgtgtgatgttggtgatggaaaatatgaatatacaatttattcttcttgttgcaatgttgacaaaggaatctattattatcgaacatatgaagacagtcaaattactgcaattgatatgaataaagaagacttagatagtcataagttaattagttatccaattatagaaaaacaacaaattaaatatataaattagttaatgtgttgtgattgattatttaatatagatataatacaaaaaggcaaagatattttcaaaacattttttcttgatgtgatatccttgtcttttttgtaatgtttttaacttattgcttttgcaaaatttatttacctgttttctggatcaacgatagtgtatattatgctatccttgtttggattttaggacgtttaaagaggcacttttttacataacttaatccatagacatagaccttttaagcatgctgtgagataataataaagaagagtttaaagcgcaccccaaaccacttccccataagtgtattacgctttaaactcttttatatttgaattcactaagaagcataccatatatttgaatttactaagaagcataccatatatttgaattcactaagaagcataccatatttttgaaaaaaagtgagaaaaaaggcttataattaggatttagagtaattaattagatgtttattttataggactgatactatagattacaaatagtatcgtatttcgcaatcttaaattatcttcttactataaataagataataaaatttgtatttgtcctttttaggtaacttattttaatctttatacctttctggatcaacgaaagtatactttatatagtcataacgccgatgatcgctccgtgcgtctggcacgtcagtcacgatatcaaacaaaaaatatacatatttcttcattctagttttcgcagcaggaattttaaagtagttcttattagaatagtagagattgattaataagctatcttcgattgctaaaaagaaaacttctgaatcccaatagcgagaaggatacacctgtaaccatgccgaacacagaagttaagcttcttagcgccgattgtagtgaggggttgccccttgtgagagtaggacgtcgccacgcttaagttatccatggaggtttagctcagctgggagagcatctgccttacaagcagagggtcagcggttcgatcccgttaacctccatatgagccgttagctcagttggtagagcatctgacttttaatcagagggtcacaggttcgagccctgtacggctcatatttttgcgggtgtggcggaattggcagacgcactagatttaggatctagcgccttacggcgtgggggttcaagtcccttcacccgcataatttaagttttacatgccggcttagctcagttggtagagcatctgatttgtaatcagagggtcgagggttcaagtcctttagccggcatctttaaacacgcggaaatagctcagtggtagagcaccaccttgccaaggtgggggtcgcgggttcgaaccccgttttccgctttgccaaagcaatcgcgccggggtggcggaactggcagacgcacaggacttaaaatcctgcggtgagtgatcaccgtaccggttcgattccggtcctcggcatttcaaatatgcgcccatagctcaactggatagagtgtttgactacggatcaaaaggttaggggttcgactcctcttgggcgcgttaattaaacgggaagtagctcagcttggtagagcacttggtttgggaccaaggggtcgcaggttcgaatcctgtcttcccgataattataaatttaaacacggggccttagctcagctgggagagcgcctgctttgcacgcaggaggtcagcggttcgatcccgctaggctccatttcatttaaataatgaatatctttttcgcggtgtagctcagctggctagagcgtccggttcatacccgggaggtcgggggttcgatcccctccgccgcgatttttaagagcctggacctttagctcagttggttagagcagacggctcataaccgtccggtcgtaggttcgagtcctacaaggtccattgtggcgttgtaagtttcatatggaggattacccaagtccggctgaagggaacggtcttgaaaaccgtcaggcgggtaaaaccgtgcaagggttcgaatcccttatcctccttttcatattatcgcgggatggagcagtctggtagctcgtcgggctcataacccgaaggtcgtaggttcaaatcctgctcccgcaatttaaaaactaaaaacactggttccgtggtgtaggggttaacatgcctgcctgtcacgcaggagatcgcgggttcgattcccgtcggaaccgccatgcgggtgtagtttagtggtaaaaccacagccttccaagctgttgtcgcgagttcgattctcgtcacccgcttttagtttttatgggcctatagctcagctggttagagcgcacgcctgataagcgtgaggtcgatggttcgagtccatttaggcccattagtacaaaatcttattggttttggggaagtactcaagtggctgaagaggcgcccctgctaagggtgtaggtcgggaaaccggcgcgagggttcaaatccctccttctccgtttcaatattttgttttacctggcccgttggtcaagcggttaagacaccgccctttcacggcggtaacacgggttcgaatcccgtacgggtcattaaattcaatatagttttacatggaggattacccaagtccggctgaagggaacggtcttgaaaaccgtcaggcgggtaaaaccgtgcaagggttcgaatcccttatcctccttttcatattatcgcgggatggagcagtctggtagctcgtcgggctcataacccgaaggtcgtaggttcaaatcctgctcccgcaatttaaaaactaaaaacactggttccgtggtgtaggggttaacatgcctgcctgtcacgcaggagatcgcgggttcgattcccgtcggaaccgttacgtctacgttttcctatttagttctatatttttattaaattttatatttgctcttttcacttttcggaataaattcactgtgactcttgataccttcttttatatattgctaatgtattttctccattgctatgaaaatagaatcaacatatttataatatctatctaatctattttcatttaaccgcagcatcttattaaataacgtgtaaataagaatataaaagttattgaactaattaataaagatagaatcatcgtagttggatacgtagatgaaacctcaactatagttctttttcccgtacctttaatagacactaaaccattgtcattttctatagtgctctttttcccatttactttcacaactgttccccaataattgaatacaggtaatgtgatattttgctcatcggcatcttctactgtatagactattttggaattatatgctttatgagatgcattctcccatcgatcaccaacttttacttcatgtttctttaaatgatctttatatttcaatgcatctaatggtgcatagtcatataggcctccagttcttgaggatgtataacgtgtaacatcttttttggtcataactaaacgacctttatacgactgaattttatgcgaataatttgcttctgttgctgcagtcacagtaaaaataataagaactattcctacaaggctccacatactttttttgttgcttgttttccactttaaaaacactatggttaagattgatgaaccaaaaagcacttgaaaacccaagattctccacggaaattgaatgatttgaataggtgttttttgtaaaatttcccatggaaaaagattcgttgataaaaaccaagtggtcactgcacaaaaataaataatcttttctttattggtaaatttttttaaaaagaaaagtggaagaatcaatgaaaccacaccaattgttcccattgtaaacgtaactaaaccattatttactgcaccgattaaactatcagaaatattcaatgccctttcttgaagatttgtgcgaaaaggacgattaattttttgatgtaggacttgttgtaacatcggataccaaacgtaagccgttaaaagaatggtccaaccaacagcttttatcatatttaatatcagatccgacatttcttttttctcttttcgcttagagaaaagagagccgataaacaataagccaataacaatcacactcataaaagtggagagaacatgggtatagatgagcaaactcatactgatagctaaaggaatcacacagttctttctttcataaagaagattatacgtgtaatacaagacaactggtataatcgtcaacgcaattgattctgaaattgcagaacgctgatatatatcaattaaacgatatccataaaagctatacaaacagctaaataagaaagctgcatctattcgcttaaagaacctttggccatattgataggtcactagaattgtacaaatattcaatacccaaacgtataaaatgtaacttagaatcaaattatttgttatccagtaaaaaattacggctggaaagagtgttagatacggataaaaaaaattgacccctccgccataactattaaatgtggtaaaatttattggaccagaaaatactgaggacaagccttttattctagaaaagtgaaaagcgatatctcctgtagttgagatcttttgtgtattactaaaaacaaaaaagaataaagactagcaataactaataatataacaagtagtactagttttttatttattttcaaaaccttttttatttctcctttcaaaaaaacacttattactaataacatcaatggttctgttgcgaagtttgaaaatcaaacgcgccctctctgaactccaaatatctcaacaaacatttttaacaagcaagcaatatgctagcaaacaaattgagcttaacaatcgcaagattgttcgaactttttatgagagtttgatcctggctcaggacgaacgctggcggcgtgcctaatacatgcaagtcgtacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaatattacggagactacacaatttgtttttactttgttcagttttgagaggtttactctcaaaaaatcaaggcacaccaaataaagccccgttcgtaaaaaattttcgatctgggcaaagaagtggtatactgtaagtggtttagttaatggtccactgagaccgcgtacgcatagacgtactctgtatgtgccctaaccatagcgtgcatacatttcagaagcttgttcatacaagcaactgtggcaaccttatctttcttagggataggttgcttttttaatttgtagtaataatcgacaatatgattaggagctgcgcgttgctggcgaatcatatttcgaatggtgaagaaaataattttccgtgctttgggattaccacgcttattgatgcggtcttggccagtatacttacctgaatgataccgtcggatgtcaattccgacaaaggcattcaattgtttatgggttttaaatcgtgtgatatctcctaattcaccgagcaataaagcggctgtgagtgcgccaatcccagggaacgtttggtacaacaaaaagcaaggagagccttcggcttttttgatcatttgtgtcgccagtgcttctttttgttcgagtaaatcttggagaagttcggcgtaatagatcgttttttgacagtggatactgtctttttcaacagctggataggcacactgtgcatagtggatgatttgatctgccttttgctcggcacgattcgcggagatttttttccgtgtttcgttgatcagtttattttttatttttgtccgagtagatgccaatacaaaatctggatggggaaaaagacggatcaatgtcaatgcgtaaggggtcagcctgtttgaaaagaactgttcaagctctggaaaagtcaactgaaggcagttgtgtaaatccatgcgcagacgagtgattttcttctcaatttcttgataaaaacgggctaaatcgcgcatctctaagtaaaaattgctttgtacttcttttggctgacgttgatttttaagatgagtctgtgcgagccgatgggcatccgatttatctgttttccaactgcgtaaggtgttttcttccatctgctttttcgcttctaacgggtttaacaaacagtaagaaaagtgatgatcttgaaagaacttttcgactggtctggaataaatccccgttgcttcaaaaacaatcaatggacgttcaggcaagtgctggatctcttcgagtaatgcatgaaatcctctttgagtgtgttcgatctcgtcttcaaataagcaggtgtcgtctttgtataggacactgtagctgtgtcccattgaaacatctaatgcaagaatgtaaggcatttgttttcctcctttttaagttttgaaagaactttactgcttcatttcgattccaatttcctatacacgggctcatggccccaacatacgtaaacctgattctaaaatgacagtaaagaagttcggtttttgatagggactcgtagtcctcaaggctttgttcgaactttctttcactcttcactataatctaaaaatagaaaatagaggagaacatcattcgtcaatgatgttcccctctaatcttagtatgtttacaatttgagtgtaccataaatgcctttttatttttctaacttaattttacaattagcgatataaaaatcagaattgaatcctagcagtttcaaaagaaaacgattaaagatcagcagagattttctgtatctttaatcgcttttttctattctgtgataccaaaaaaatgtttgaatcgatgaagaagcgttccttgttttaattctataaattcttgtgcaatcggatatttttcttccaaattttctttgttcttttcaatcagactttttgcttcttcatattttttatctgcacataatacttttacttcctgtaaaacttttcctgcttccatttacctcaccctcttgccttttttatggctttaagtttgatttaagctatacgcattattctatattcatcccaaataaccttttttcattttttactcctcgaaccaatcagttttctaaagactgattggttcgtcttttttatttttcatccattttatgctgctcttctgctaatttgtctaatgctttaatggatgtaacagttttcgcataatcatagctgtataattctgtaaatttatcaggcagaacaaaccacgctggatggtagccgttcgcagtgatcgggaatcctttgtcttgttgattatctccatcccaccttacagcaacacctttttttcctttccactttattaaagcaatcgagtatcctttttttgtttgtgtgccgtcttcaataattgctaaaatttctattttttcttttggtgcacgaacttcttgagggcgaaccattttctattcctcccttatctaattacttcacgaccaatacactgcaaggggcatgtgaaacgacataagaagcggttgatccgactagtgcttgttgtatagctccttttcctgtcgctcccataacgatcaaatcaatattttcttgtccagggatgacattggcaatcaaatttcttggatctccagtttcaactattgcatggatctcagcaatgccgaactctttggcatcattgatttttttcagcatggctacttctgttctttgtttttcatctgcatagatttttgaaaaggcataggcactatgggtcagctcaactttgttgatgattgacacgataaataagtgggcttcattgtcctttgctaagtcaagggcttcagcgaacgctttgatcgattgtcttgatccgtcaactgctaccatgatgttctggtatctcttactcattggaaccgcctcctttttcttttattgtaacatctcaagcaaaaatacaaaaaatatacgcaatgtgtaaataaaatgatgattaatagcaatttttttcaagttatttatacatttctgttctcatcagaacacttgttctaaacctatcatttctgcattatgtggaatttctcatcatttttcacatgagatgaacatcattctgttacaaaaaacgtggatttgtcataaattgtcatgcttcttttacctatgaaataatttttgagctatgtacaagaagcattttattctagcttaatttgacaaatcataatcataaagatatagatacataatcattttcgcttacatatatttgaatatgaactaaaaacagcaagaaagaagatgatcaaatgtattatgtagaagtaaaaacaaaaggtgtcaaaaacaaacattatgtgaaaggcatgagtaatgagtatcctttacttggttcatggaaagaagcagcacctttttccaaaccatgtgccataaaaataaagagcgagctggaaaaagaactgacttgcggcaaagcagttgtaaccatcatcgaaaagtaacagtgcaaaaactaatgaatgacttattccaacacttaagccgtatagaaaggaagcaaaatatggattatactgttgagtttgacagtgaactattggaacaatttccgcaagaggtacatctcgcatacaaaaaaactatttctaaaaaagtcatagagcatgtagaccataatttttttcgtataaaaccaatacgaacacgctcggcaaagggaatatatgaaatgaaagtcaatattgataaaaaaaattatcgtatagcattttcttttaaaaaaaatcatgtattcattttttatattagtccaaatgtacaaaaaatagtatttgataaagaagtgaataaaaaaataaaatagacgaggataggaggatagattgagtgatacttgaatctatcctcccatttttttctttttacgttatacatagtatttgtcattaccaaaaagaccctcttatcttctagtatcctttatataagaaacagcatccatttcttttacttgaacaaatcctactgattcataaaatttttttgttttctcagtatcatctgtcaataattcgatttggactggtccataactggtgatcttctccaaagcttcattcaaaagcgctttgcctattccttggcgctgatacctcggatgaatgaggatatcttgaataaatgcgatcgtcgcaaaatcagtgatccaacgaacgactccgataatcttctcttctccattacgctttaccagagattcagattgttcaaatgctctagctaaccttgcagtgtcttttgtgtaatgcgtccaaccaacgctcttatataattcagaaatctcatcgatcataagggaatcaacattcatttttttcttcctttcttatacaattctccctctaataatacaattctttgactatttaatctatcacgtataacgctcctgtaaagattctctcaattccttaaaattcctctttccttttagaatgcatcctttttgataaataaaacatactaagattagaggggaacatcattgacgaatgatgttctcctctatttaaagaagttattttttaaaagtttacttttactaaaattcctatttattatctccacattatttaaaactatggaatcaatagttttctccaatgggataacaggactaaagactcctatatctttaggaaatccctttttaaaaaaatcgcttggataaacagttttattcagaaacatatcatcattaaaactgacaaaatgttcagataaaccaggtaatttactaaaatttaactcaatgacatttgagttaaatgtgggtaaatagttctcatcaatgaaatcactatgcttgattacctttagcttttcataagataaatctaaccattctggaagatgaccttctgttacaaagtaaatccgattcacccatggggcatttttttctacagaacgaaaccaatattttagaaatccccaatctctataccttgaagcatcgtttagtttcatattatattctagtgcgtaattatctttactttttttccaaagtgcatcactctcatctacccaagttatgacaaaatcaattttttctttcacaattattcctcagttcgtcgttttattattctacctggatttccaacaattacacaattatcaggataaacactatttaataatgtattagctcctatgatacagccattccctattttagcaccatctaaaaaaactgctcctgatccaatccaaacattattaccaacaacgataccttttctgttaacaccttggagacggattggagtatttagatcctgataattatgattttctgagtgaaaccgaacattctgtccagaaattacatcttctccaatatttatcccaccagcagcaccaaaataagtattttcagcaaaacttgaattagttccaatagaaattccttttcctaagtcagctaaactaccagagcaattaatctcactccctcttccaattttaactctatcacctaagaatatacctttttttgataacgcattaataaaaacactgtcttcgattctaacattatctccacagttcaatttatttttacaataaatctttactctagatcctataaataatttagtgccttttacaattccaatccctctaatttttcctctcaacagtccaatcaaaaatcgagatccaaaatgaataacataaattagtgggacatttttagataaaataaattctttttttccagtaattttttttattaccttttctataagactgattatcaaaatatttaccaccttaaacaattatatactattaataaaaatatgaattttacacagagttttatactttataaaattgaagatcagtacagagaagaaacaaaagagaagtgatatgagtgtttaaaccactaatagattcatactcggcggtactaaagaaatttaaaggtaacgacattggtgcaacaatcaacgaagaagtaaatatcgaacggctgaaaacgatgtatgacggctatgatggcgatcgaatcattgaaattcgttttattgatccacgtcggttcaccgcacagcaacgaaacttcatctatgcgctgataggcgatatttttatcgatacaggcatgccaacggacttctggaaggaattcttctacttccgtttcgaaggtgtcacagggcgcaaaataagcctgaaagatgaatctaatacaactgtgagtgatgccaacgtcttagcaaatattatcttagatttcatctttgaacatcatattcctttcaaagaaggctatgagattttaccagcgaatcaagaatattacttctacaaatgcatcacaaaaagagtctgctgtatctgtggcaaaacaggagctgatattgatcactttgacaaagcgctaggaagacgaaagcgcaaagaagttgatcattcagagtacacatttgcagcactctgcagaatccatcacacagagaaacacaaaataggtgtgatcaatttcaaaaataaatatcaaatcaaaggaatcaagttaaaccaggaaacaattaaaaagttaaggataggaggataaatttggctgagataagttggatcaaacttaaaactactatgtttgacgatgaaaaaatacgattaatccaagctgttcctgagtcggatgccatcatcgttatatggattcgattactagttttagcaggaaagactaacgacgatggtctgatatatatccagaggaacatgccttataccgaagaaatgcttgctacattgttcggcaaaaacgtaaatacggttcgcctagcgctaactacattggcaaatttcaacatgattgatctaggcagtgatggactgattgccatcagtaattgggaaaaacatcaaaatatcgaagggatggataaagtaaggctaaaaaacgctgaaagaaaccgtaaatacagagaaagaaagagacaggaacgtctcaaattggaaaatgacgttagcgtgacgtcacgtgacggtacagataaagatatagaagaagatatagatatagataaagaagaaaagaaaggtaagtattctgacgaacacttacgccttgctaaaaaattgcaaagtaatttaactgaagattttcctatttattcatgcgatactacctttcactggttttatgcgcttgtctgctgtttgttggaatttcagcgcataaccttctgaattcttaaatatcctagaaacaattctttcgccgtaggcttctcttagctcaggaccagataagtttgttgtgatgatcgttgctttgttctgtctggcttctaagagcgtgtttaacgtgttgtttgtaaactgcctactatttgataccccgctacctagttcagctccaatatcgtcaaaaaccaccaaatcagttgttttgatatcggctataagcgatccttcaatttcttttctcagttcagcattgttataagagaactttatttgctctaataattcttgatagcttataaaaagtattttcttgtcataatttgagcgctcaagtatttcccaagctgtagccattgataagtggcttttcccgcttcctgatttccctgatagaataaaatgtgcaggatggttcagcagaacctcatttgtatagctttttgctttttctaaagcgatttttgtttcttgatccactacgtgataattttccattttgcatttaaacaaagttttatctgttaataccgaaccattttgaaaaaaactcaacgctcgtgcttttaagctgtcgttatatatccgttcggtctgtatatcctctttcacacgtaacgctttataaccacaactcatgcatgttggtttacaacgttctgacccgtccttatttttccctcgccaactatacaaaggttcgctgcactctgggcattttccactttgtactaaaactcttcttattagcttttccatagtacttgctaggctttccatcagttgtatctcctttgttaaattggcaagtcgtcatattcactaggattgctgtactgtagtttttgactttgctttttatgatttttcttgtctgctttgatttcgaatttgagcttctcaaatttttctctcaatttcttagcacttctaatatttccaaaccaaaattcatttgtaggtagccaattgatcacatactcaatcgcttctatagatgctttatctctttcttccatcaacctgattgtgtctgcccatttttcgatatctactttattcatttcttttggaaaatcttcagttaaattactttgcaattttttagcaaggcgtaagtgttcgttgtgtaaatggaaaagcccattctgttgatcaagttaaaacattgattctaatgtatcatgtatttctttaaaacctttatgaactcggcatagaaacttttgattatagttgttgaattgagttactagaaatctctccagagattcttcattaggaaattgctcttttcttttggtatatttctttaattgtttgttaaaaccttcaatcaaattagttgaataaatagttcttctgattgacggagggaaattataaaaggttaatatagcaggattcatgagcaatttaaccactcgtggatactgctttttccatttatctatcataaaccttatttgattatttgcttcttcttttgaacttgcttgataaactaatttgaaatcgctacagatttcttgtcgatcactaacacgaaccttatgagcgatatttctagatatatggacacaacattgttgaaattgagcatttggataaacactatgaatactatcgttaatgccacttaaaccatcagttacgactaataaaacctcttttaaaccacggtcttttaggtcttgaagaatctctttccaaacataagcagattcagttggagcaagactaaacccaagaacctctttggttccatctaatcgaatgccaattacaatataaactgcttcttttgaaacagtttgtctttttaaaggaatgtgagtagcatccataaaaatgacagagtatctggattctaaggacctttctttaaaggcaataatatcttcagaaactattttagtcatatttgaaatggtttgtggcgtatagtgatgcccgtacattttttcaatcaattcagagatttcagacatagtaattcctttttgaaatagctgaataatagtggtttctaaagagtcattggttcttttataagcaggtaaagtttgttgagaaaacttaccatttctatctctaggaatcaccaaatttaattctccatactctgttctgaatgaacgtgaataattcccattacgggaattacctgaattgaacccagcacgatcatatttttcataatcaagaaaagctgttaattcagcctgcaataatgaattaacagctaattctaaatgacatcgaaataattcatctaaatcacctttattgattagtgtttccataatttctgtagtaaaattggataggctacaattaactagacagaaaaattaaggtgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagagacaagtaatcgatgcgaataagcatctttaccctatatcagcgatgtgcagaatattaggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtagaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgttgaaagtagaatttgtctatcaatacacatttgaaaccttacaacaattggatttggagttatttgactatgtcaattggtggaagcaagcgtctcattctgaacataccaaatgctaccgccgcttcttcaattcactaatatgcctatattaaaaacaatagctactacaaatacgaatagaccattttctacaagatagtttaacatttgtgaatgtatcggtatatctacaatgccaaaattattatataaatagctacgccactgacctgaaccaataccgcttagaagatgatgttttgctcccaaattgatagcattattaaactgaatcatcctactgttttctgtatttcctctatttaaaaagaacacttgatatattttatcaaacaataaaaataatgctagaaaacttataccgacaaaggaaatagttaataaacttttttttaaaaattgacttctagtagaactcttattgaaggtataaattagtattagtgagggaactatacctaataatgcaatacgtgtttgagttaataatataaagagaaaagtaagcatcgttgcagataaagaaagtaaatccttttttctgtaaagattaaataaagcaataataaatagtaatgcgcctaaattgcctgctgagttattcgaacccgcaataccgacggcccgattactatctacaataccttctgtataaagaatagattctgaaaaactaccgattaataaagtttttttagttagcatttgtagaatacccaatattccatttagaatcgctaaccaattaaaagtacgaaaaaaactttctatataaaaatttttgattgatttgcataaaagaaaacatagataaatggaaacatagtttaggataacccttaagaacattggaaaattatctattgatatattatcagaaaaaatactatagattatatttataagtaatgttataaaatatagatattcccaacttaatctaaaagtttttttattaagaaaatatagtaccgctgaaaatattattattgttgctacatttacatataattttaaatattctcctacaattctatattcaagtgaatttatactgatattaaatgcaatgtacagtaataaaggaattatttgaatcactttgtctttatctttaattatggccttatatgctaatttttcaaatgacaataagatattagtataacctttcctttattctaatttcattggttaaattgaagtttcattaaaaagtttaacaaatttctagttaacaaacacgatgctaatttttagataagaggcatttgcaagtagaaaataaatttaagttacactggcaaatgtaaaaattttaattgtcagtatttagggtaaaaaattcttaagccaaattctgattggtcttgatatttgttcatattagcaaaatgatacctacttatttttgtcttgtaatacaattcttgtatataaccatgtcgtcaatacatagtagatgaaatacaattcgaagaagatcgtaaatggcacctaaatatttttgtatggattttgcatgaatagaccaaacatttgtaacccgaacaagacatggactacacctaagattcctggtgctaagaataacacacctacttctttacggatcgattgtttaagcaatccgcatagcgaccattgaaagcatttgtgtatattcacgaatacgaaaacttaactgggacaaggtgaaattgttcaactttttcaatgagatctgttctgatttctttagtaatgataaaaaaaatgatcacaacatgtaatagcaacacctgcaaaaacttctacagttttacccccattaaaaagataattgtaatcttctacaggataagccacaggtccaccagaaacttgtttgaaatagatttcaaagctgacttctatcttgacttcctgctcatcttttttcgttttatgagaaaaagcatggaatgcgctgcatcaggtatcgaggcttagaaaaaaatcaggtgcatacgatgcttgtttttgccgaaatgaatctgaaaaaattggtcacttggcagtgggagcatatgtcttcatattttttattatacaaaaatagacaaaagtatcagtctacactcttagtaaagaggaaactgatacttttgcctacagtatgatatttcttacatctacttttactccggcagtaggactcgaacctacgacatcatgattaacagtcatgcgctactaactcaaaggaatgaaagcaaatgatcttttagtaggtattttggttgttattgtattcattatgctagttctaagacatacaatattcaaaaacagccaatttgattttcttccgctgatttcatttattgttgtattagggattcttattgttagtttcataaacgtagaacctacgaaaaaacatgaggtattcgttgaaaagggcctgggatttgggtatactatcaatcctagaaatctgtttggactgtttctctatattattttgctagtagcaactatattgccttactttatataaagtaagcttttaagtctccaaaaattgtaaatcatttattaataagagcatacaaaactcaaccatgtagatatatagcgtatgtaatctaaagaaatcaatttaaagataaacgtaaagtatgacgctaagagggaactgtgacaaaagtcttgtcgcagttcctttttccgaataaacggagttcaaaagcttgcatctgcggtaataagctcaaccaaacgtaaaatatgaggaactatttttgtttggctgttcttattacttgatgcagggcagctttttcacaacctctgatacacggtgttccagaagtaacttcttcgaaaaataagccgaaatttcacaaaaatttgaaaagcaattttcgtaaattccttcttatttcttgaagctacccacttctgtcacaacctccatccattatgaaaggagaacactgcaagcagaactacggtcttctgtatgattcaaagagatgtcgattttcaaagtttgaaacataatctaaaaaataaatatctctattatctaaatgttcctgttcgattccttgttggattctaaagtcaatagctaataaactgcaatttgtttccatgatccccagtgacgcttcgaatataatataaattgttcctttctttaacctagggagtgtgattggattttttgcatatgactgacaatatattttactttttgagttgtcttcttggataggctacaattaactagacagaaaaattaaggtgtgtagactagaagaaaaattgtaaaattaagttagaaaaataaaaaggcatttatggtacactcaaattgtatttccgacgaaagaaaacaaaggagtgtaaccataaatgacctacaaacatcttaccatagacgaactgacaatgatagaatcatattatcttcaacataataagccggttgaaatcgctaaccgaatgggacgtgctatacaaactatttataatgtagtcaataagttcaagcaaggcaagactgctcttgattattggcaccagtataaagaaaataagaaaaaatgtgggagaaaagtcattcaattacctgctcatgaagtagattacattaaagagaaagtcactcttggttggacgcctgacgtcattatcgggcgaaaagaaaggcctgtttcatgcggtatgagaacactttatcgtttattttctaaaggaatatttgatattgacacactaccgatgaaaggtaaaagaaaacccaatggccatcaggaaaaacggggaaaacaacagtatcagcgctcaatccatgatcgacctgataattatcctgatttcaattctgagtttggtcaccttgaaggtgatacgatcgttggcattcatcataaaagtgccgtcattactttagttgaaagattatctaaagtcattatcacgattaaacccaacggccgtaaggcattagatattgaaactgcccttaatcaatggttttctcgcttccctaaaaacttctttaaatctattacgtttgactgtggaaaagaattttctaactggaaagccattagtaaccaacatgatattgatatatattttgcggaccctggaacaccttctcaacgcccattaaacgagaattctaacgggattctgcgtcgtaatggactgccgaaatcaatggattttagagaagtgaatcagacatttatttccagtgtcagcaatcaacgtaatcatattccaagaaaatcattgaattacagaacaccaatcgaaatatttttgagctatgtacaagaagcattttattctagcttaatttgacaaatcata
